US007667001B1

(12) United States Patent
Pollock et al.

(10) Patent No.: US 7,667,001 B1
(45) Date of Patent: Feb. 23, 2010

(54) NUCLEOTIDE AND AMINO ACID SEQUENCES, AND ASSAYS AND METHODS OF USE THEREOF FOR DIAGNOSIS OF LUNG CANCER

(75) Inventors: Sarah Pollock, Tel-Aviv (IL); Zurit Levine, Herzlia (IL); Amit Novik, Beit-HaSharon (IL); Dvir Dahary, Tel-Aviv (IL); Rotem Sorek, Rechovot (IL); Amir Toporik, Azur (IL); Shirley Sameah-Greenwald, Kfar-Saba (IL); Osnat Sella-Tavor, Kfar Kish (IL); Alexander Diber, Richon-LeZion (IL); Gad S. Cojocaru, Ramat-HaSharon (IL); Michal Avalon-Soffer, Ramat-HaSharon (IL); Shira Walach, Hod-HaSharon (IL); Pinchas Akiva, Ramat-Gan (IL); Naomi Keren, Givat Shmuel (IL); Ronen Shemesh, Modiln (IL)

(73) Assignee: Compugen Ltd. (IL)

( * ) Notice: Subject to any disclaimer, the term of this patent is extended or adjusted under 35 U.S.C. 154(b) by 0 days.

(21) Appl. No.: 11/978,554

(22) Filed: Oct. 30, 2007

Related U.S. Application Data

(63) Continuation-in-part of application No. 11/051,720, filed on Jan. 27, 2005.

(60) Provisional application No. 60/620,916, filed on Oct. 22, 2004, provisional application No. 60/620,874, filed on Oct. 22, 2004, provisional application No. 60/589,815, filed on Jul. 22, 2004, provisional application No. 60/607,307, filed on Sep. 7, 2004, provisional application No. 60/620,853, filed on Oct. 22, 2004, provisional application No. 60/628,112, filed on Nov. 17, 2004, provisional application No. 60/539,129, filed on Jan. 27, 2004.

(51) Int. Cl.
*C07K 16/00* (2006.01)
(52) U.S. Cl. .................................. 530/387.1
(58) Field of Classification Search ............... 530/387.1
See application file for complete search history.

(56) References Cited

U.S. PATENT DOCUMENTS

| | | | | |
|---|---|---|---|---|
| 5,236,844 A | * | 8/1993 | Basset et al. | 435/320.1 |
| 6,251,386 B1 | | 6/2001 | Johansen | 424/94.4 |
| 6,613,515 B1 | | 9/2003 | Xu et al. | 435/6 |
| 6,625,545 B1 | | 9/2003 | Amitai et al. | 702/19 |
| 6,720,146 B2 | | 4/2004 | Stolk et al. | 435/6 |
| 6,812,339 B1 | | 11/2004 | Venter et al. | 536/24.31 |
| 2004/0005579 A1 | | 1/2004 | Birse et al. | 435/6 |
| 2004/0101876 A1 | | 5/2004 | Mintz et al. | 435/6 |
| 2005/0255114 A1 | | 11/2005 | Labat et al. | 424/146.1 |
| 2006/0040278 A1 | | 2/2006 | Cojocaru et al. | 435/6 |
| 2006/0172311 A1 | | 8/2006 | Cohen et al. | 435/6 |

FOREIGN PATENT DOCUMENTS

WO  WO 03/105758 A2  12/2003

OTHER PUBLICATIONS

Steel et al (Protein Engineering, 2000, 13(6):397-405).*
Affymetrix, "GeneChip® Human Genome Arrays", 4 pages.
Affymetrix, "Human Genome U133 Plus 2.0 Array", http://www.affymetrix.com/products/arrays/specific/hgu133plus.affx, 2 pages.
Affymetrix, "Human Genome U133 Set", http://www.affymetrix.com/products/arrays/specific/hgu133.affx 2 pages.
Affymetrix, "Human Genome U133A Plus 2.0 Array", http://www.affymetrix.com/products/arrays/specific/hgu133av2.affx, 2 pages.
Barrett et al., "NCBI GEO: mining millions of expression profiles—database and tools", *Nucl. Acids Res.*, 33:D562-D566 (2005).
Boguski et al., "dbEST—database for 'expressed sequence tags'", *Nat. Genet.*, 4:332-333 (1993).
Burgess et al., "Possible dissociation of the heparin-binding and mitogenic activities of heparin-binding (acidic fibroblast) growth factor-1 from its receptor-binding activities by site-directed mutagenesis of a single lysine residue", *J. Cell Biol.*, 111:2129-2138 (1990).
CBS, "Instructions", http://www.cbs.dtu.dk/services/TMHMM/TMHMM2.0b.guide.php, 3 pages, Oct. 29, 2003.
CBS, "Scientific Background", http://www.cbs.dtu.dk/services/SignalP/background/prediction.php, 2 pages, May 6, 2004.
Ch.EMBnet.org, "TMpred—Prediction of Transmembrane Regions and Orientation", http://www.ch.embnet.org/software/TMPRED_form.html, 1 page.
Edgar et al., "Gene Expression Omnibus: NCBI gene expression and hybridization array data repository", *Nucleic Acids Research*, 30(1):207-210 (2002).
Hazkani-Covo et al., "Evolution of multicellularity in Metazoa: comparative analysis of the subcellular localization of proteins in Saccharomyces, Drosophila and Caenorhabditis", *Cell Biol. Int'l*, 28:171-178 (2004).
Hofmann and Stoffel, "A database of Membrane Spanning Protein Segments", *Biol. Chem.*, Abstract MF C-35, 374:166 (1993).
Krogh et al., "Predicting Transmembrane Protein Topology with a Hidden Markov Model: Application to Complete Genomes", *J. Mol. Biol.*, 305:567-580 (2001).
Lazar et al., "Transforming growth factor α: mutation of aspartic acid 47 and leucine 48 results in different biological activities", *Mol. Cell. Biol.*, 8(3):1247-1252 (1988).

(Continued)

*Primary Examiner*—Sean E Aeder
(74) *Attorney, Agent, or Firm*—Mintz, Levin, Cohn, Ferris, Glovsky and Popeo, P.C.; Ivor R. Elrifi; David E. Johnson

(57) ABSTRACT

Novel markers for lung cancer that are both sensitive and accurate. These markers are overexpressed in lung cancer specifically, as opposed to normal lung tissue. The measurement of these markers, alone or in combination, in patient samples provides information that the diagnostician can correlate with a probable diagnosis of lung cancer. The markers of the present invention, alone or in combination, show a high degree of differential detection between lung cancer and non-cancerous states.

9 Claims, 122 Drawing Sheets

OTHER PUBLICATIONS

NCBI, "Expressed Sequence Tags database", http://www.ncbi.nlm.nih.gov/dbEST/, 2 pages, Jul. 11, 2000.

NCBI, "Genbank Overview", http://www.ncbi.nlm.nih.gov/Genbank/GenbankOverview.html, 2 pages, Sep. 20, 2004.

NCBI, "Gene Expression Omnibus", http://www.ncbi.nlm.nih.gov/projects/geo/, 1 page.

NCBI, "Geo Overview", http://www.ncbi.nlm.nih.gov/projects/geo/info/overview.html, 3 pages.

NCBI, "tissue-specific pattern of mRNA expression", http://www.ncbi.nlm.nih.gov/geo/query/acc.cgi?acc=GSE1133, 2 pages, Mar. 19, 2004.

Skolnick et al., "From genes to protein structure and function: novel applications of computational approaches in the genomic era", *Trends in Biotech.*, 18(1):34-39 (2000).

Sorek et al., "*Alu*-Containing Exons are Alternatively Spliced", *Genome Res.*, 12:1060-1067 (2002).

Su et al., "A gene atlas of the mouse and human protein-encoding transcriptomes", *PNAS*, 101(16):6062-6067 (2004).

The MGC Project Team, "The status, quality, and expansion of the NIH full-length cDNA project: the mammalian gene collection (MGC)", *Genome Res.*, 14:2121-2127 (2004).

Tockman et al., "Considerations in bringing a cancer biomarker to clinical application", *Cancer Res.*, 52:2711s-2718s (1992).

\* cited by examiner

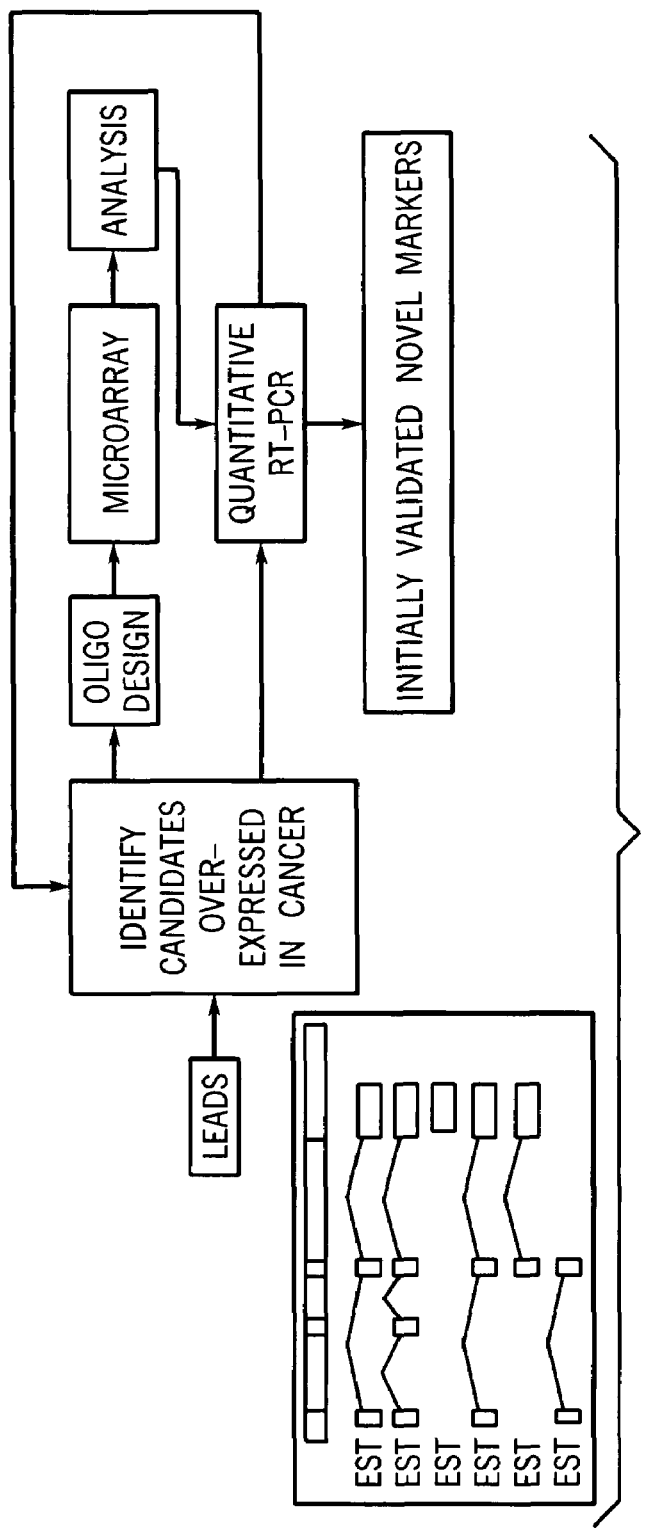

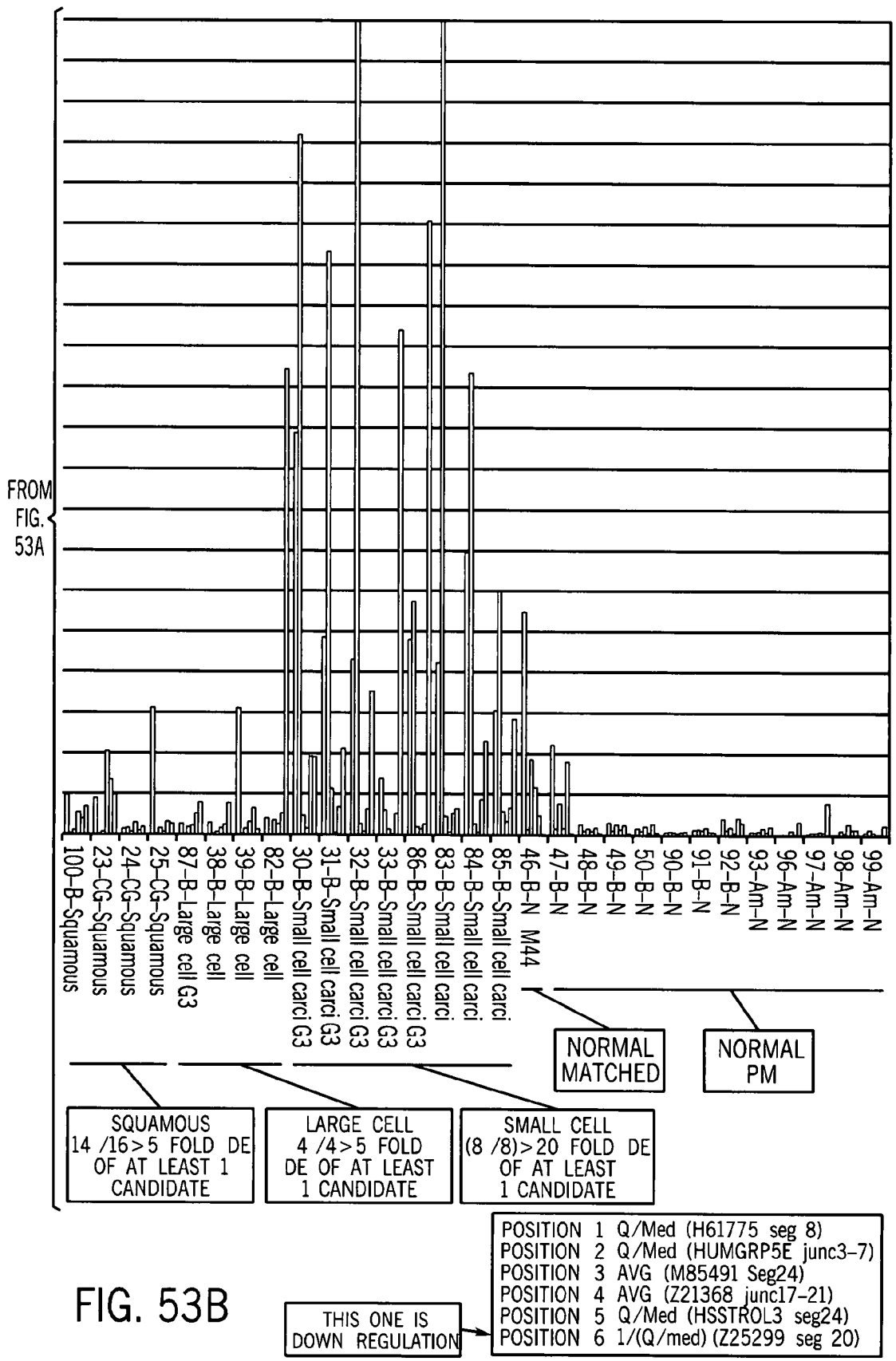

>gi|47124622|gb|AAH70449.1| Mapkbp1 protein [Mus musculus]
Length = 1503

```
Score =  911 bits (2354), Expect = 0.0
Identities = 447/759 (58%), Positives = 576/759 (75%), Gaps = 11/759 (1%)

Query: 40   APPICLRRRTRLSTASEETVQNRVSLEKVLGITAQNSSGLTCDPGTGHVAYLAGCVVVIL 99
            +P I LRR      E + ++V+LEKVLG+T    GL CDP +G VAY AGCVVV+
Sbjct: 19   SPSIKLRRSK--AGNRREDLSSKVTLEKVLGVTVSGGRGLACDPRSGLVAYSAGCVVVLF 76

Query: 100  DPKENKQQHIFNTARKSLSALAFSPDGKYIVTGENGHRPAVRIWDVEEKNQVAEMLGHKY 159
            +P+++KQ HI N++RK+++ALAFSPDGKY+VTGE+GH PAVR+WDV E++QVAE+ HKY
Sbjct: 77   NPRKHKQHHILNSSRKTITALAFSPDGKYLVTGESGHMPAVRVWDVAERSQVAELQEHKY 136

Query: 160  GVACVAFSPNMKHIVSMGYQHDMVLNVWDWKKDIVVASNKVSCRVIALSFSEDSSYFVTV 219
            GVACVAFSP+ K+IVS+GYQHDM++NVW WKK+IVVASNKVS RV A+SFSED SYFVT
Sbjct: 137  GVACVAFSPSAKYIVSVGYQHDMIVNVWAWKKNIVVASNKVSSRVTAVSFSEDCSYFVTA 196

Query: 220  GNRHVRFWFLXXXXXXXXXXXXXXPLVGRSGILGELHNNIFCGVACGRGRMAGSTFCVSYSG 279
            GNRH++FW+L              PL+GRSG+LGEL NN+F  VACGRG A STFC++ SG
Sbjct: 197  GNRHIKFWYLDDSKTSKVNATVPLLGRSGLLGELRNNLFTDVACGRGEKADSTFCITSSG 256

Query: 280  LLCQFNEKRVLEKWINLKXXXXXXXXXXXQELIFCGCTDGIVRIFQAHSLHYLANLPKPHY 339
            LLC+F+++R+L+KW+ L+           QE IFCGC DG VR+F  +LH+L+ LP+PH
Sbjct: 257  LLCEFSDRRLLDKWVELRTTVAHCISVTQEYIFCGCADGTVRLFNPSNLHFLSTLPRPHA 316

Query: 340  LGVDVAQGLEPSFLFHRKAEAVYPDTVALTFDPIHQWLSCVYKDHSIYIWDVKDINRVGK 399
            LG D+A   E S LF    A YPDT+ALTFDP +QWLSCVY DHSIY+WDV+D  +VGK
Sbjct: 317  LGTDIASITEASRLFSGGVNARYPDTIALTFDPTNQWLSCVYNDHSIYVWDVRDPKKVGK 376

Query: 400  VWSELFHSSYVWNVEVYPEFED-QRACLPSGSFLTCSSDNTIRFWNLDSSP--DSHWQKN 456
            V+S L+HSS VW+VEVYPE +D +ACLP SF+TCSSDNTIR WN +SS    S  +N
Sbjct: 377  VYSALYHSSCVWSVEVYPEIKDSHQACLPPSSFITCSSDNTIRLWNTESSGVHGSTLHRN 436

Query: 457  IFSNTLLKVVYVENDIQHLQDMSHFPDRGSENGTPMDVKAGVRVMQVSPDGQHLASGDRS 516
            I SN L+K++YV+ + Q LD + P   +G+ MD + G+R + +SP+GQHLASGDR
Sbjct: 437  ILSNDLIKIIYVDGNTQALLD-TELPGGDKADGSLMDPRVGIRSVCISPNGQHLASGDRM 495

Query: 517  GNLRIHELHFMDELVKVEAHDAEVLCLEYSKPETGLTLLASASRDRLIHVLNVEKNYNLE 576
            G LRIHEL   + E++KVEAHD+E+LCLEYSKP+TGL LLASASRDRLIHVL+   Y+L+
Sbjct: 496  GTLRIHELQSLSEMLKVEAHDSEILCLEYSKPDTGLKLLASASRDRLIHVLDAGREYSLQ 555

Query: 577  QTLDDHSSSITAIKFAGNR-DIQMISCGADKSIYFRSAQQGSDGLHFVRTHHVAEKTTLY 635
            QTLD+HSSSITA+KFA +    ++MISCGADKSIYFR+AQ+  +G+ F RTHHV  KTTLY
Sbjct: 556  QTLDEHSSSITAVKFAASDGQVRMISCGADKSIYFRTAQKSGEGVQFTRTHHVVRKTTLY 615

Query: 636  DMDIDITQKYVAVACQDRNVRVYNTVNGKQKKCYKGSQGDEGSLLKVHVDPSGTFLATSC 695
            DMD++ + KY A+ CQDRN+R++N  +GKQKK +KGSQG++G+L+KV DPSG ++ATSC
Sbjct: 616  DMDVEPSWKYTAIGCQDRNIRIFNISSGKQKKLFKGSQGEDGTLIKVQTDPSGIYIATSC 675

Query: 696  SDKSISVIDFYSGECIAKMFGHSEIITSMKFTYDCHHLITVSGDSCVFIWHLGPEITNCM 755
            SDK++S+ DF SGEC+A MFGHSEI+T MKF+ DC HLI+VSGDSC F+W L  E+T  M
Sbjct: 676  SDKNLSIFDFSSGECVATMFGHSEIVTGMKFSNDCKHLISVSGDSCIFVWRLSSEMTISM 735

Query: 756  KQHLLEIDHRQ----QQQHTNDKKRSGHPRQDTYVSTPS 790
            +Q L E+  RQ    QQ  T+ ++ SG +    V PS
Sbjct: 736  RQRLAELRQRQRGIKQQGPTSPQRASGAKQHHAPVVPPS 774
```

FIG. 63A

>gi|34856717|ref|XP_342499.1| ☐ similar to JNK-binding protein JNKBP1 [Rattus norvegicus]
    Length = 1530

Score = 910 bits (2353), Expect = 0.0
Identities = 467/868 (53%), Positives = 611/868 (70%), Gaps = 29/868 (3%)

```
Query:  40  APPICLRRRTRLSTASEETVQNRVSLEKVLGITAQNSSGLTCDPGTGHVAYLAGCVVVIL  99
            +P I LRR    +   E +  ++V+LEKVLG+T   GL CDP +G VAY AGCVVV+
Sbjct:  18  SPSIKLRRSK--AGNRREDLSSKVTLEKVLGVTVSGGRGLACDPRSGLVAYPAGCVVVLF  75

Query: 100  DPKENKQQHIFNTARKSLSALAFSPDGKYIVTGENGHRPAVRIWDVEEKNQVAEMLGHKY  159
            +P+++KQ HI N++RK+++ALAFSPDGKY+VTGE+GH PAVR+WDV E+NQVAE+ HKY
Sbjct:  76  NPRKHKQHHILNSSRKTITALAFSPDGKYLVTGESGHMPAVRVWDVAERNQVAELQEHKY  135

Query: 160  GVACVAFSPNMKHIVSMGYQHDMVLNVWDWKKDIVVASNKVSCRVIALSFSEDSSYFVTV  219
            GVACVAFSP+ K+IVS+GYQHDM++NVW WKK+IVVASNKVS RV A+SFSED SYFVT
Sbjct: 136  GVACVAFSPSAKYIVSVGYQHDMIVNVWAWKKNIVVASNKVSSRVTAVSFSEDCSYFVTA  195

Query: 220  GNRHVRFWFLXXXXXXXXXXXXXPLVGRSGILGELHNNIFCGVACGRGRMAGSTFCVSYSG  279
            GNRH++FW+L             PL+GRSG+LGEL NN+F  VACGRG+ A STFC++ SG
Sbjct: 196  GNRHIKFWYLDDSKTSKVNATVPLLGRSGLLGELRNNLFTDVACGRGKKADSTFCITSSG  255

Query: 280  LLCQFNEKRVLEKWINLK------XXXXXXXXXXQELIFCGCTDGIVRIFQAHSLHYLAN  333
            LLC+F+++R+L+KW+ L+                QE IFCGC DG VR+F  +LH+L+
Sbjct: 256  LLCEFSDRRLLDKWVELRNTDSFTTTVAHCISVSQEYIFCGCADGTVRLFNPSNLHFLST  315

Query: 334  LPKPHYLGVDVAQGLEPSFLFHRKAEAVYPDTVALTFDPIHQWLSCVYKDHSIYIWDVKD  393
            LP+PH LG D+A   E S LF  A A YPDT+ALTFDP +QWLSCVY DHSIY+WDV+D
Sbjct: 316  LPRPHALGTDIATITEASRLFSGGANARYPDTIALTFDPANQWLSCVYNDHSIYVWDVRD  375

Query: 394  INRVGKVWSELFHSSYVWNVEVYPEFED-QRACLPSGSFLTCSSDNTIRFWNLDSSP--D  450
               +VGKV+S L+HSS VW+VEVYPE +D  +ACLP  SF+TCSSDNTIR WN +SS
Sbjct: 376  PKKVGKVYSALYHSSCVWSVEVYPEIKDSNQACLPPSSFITCSSDNTIRLWNTESSGVHG  435

Query: 451  SHWQKNIFSNTLLKVVYVENDIQHLQDMSHFPDRGSENGTPMDVKAGVRVMQVSPDGQHL  510
            S   +NI SN L+K++YV+   Q L D   P   +G+ MD  G+R + +SP+GQHL
Sbjct: 436  SALHRNILSNDLIKIIYVDGNTQALLD-TELPGGDKADGSLMDPRVGIRSVCISPNGQHL  494

Query: 511  ASGDRSGNLRIHELHFMDELVKVEAHDAEVLCLEYSKPETGLTLLASASRDRLIHVLNVE  570
            ASGDR G LR+HEL   +EL+KVEAHD+E+LCLEYSKP+TGL LLASASRDRLIHVL+
Sbjct: 495  ASGDRMGTLRVHELQSLSELLKVEAHDSEILCLEYSKPDTGLKLLASASRDRLIHVLDAG  554

Query: 571  KNYNLEQTLDDHSSSITAIKFAGNR-DIQMISCGADKSIYFRSAQQGSDGLHFVRTHHVA  629
            + Y+L+QTLD+HSSSITA+KFA +    ++MISCGADKSIYFR+AQ+ +G+ F RTHHV
Sbjct: 555  REYSLQQTLDEHSSSITAVKFAASDGQVRMISCGADKSIYFRTAQKSGEGVQFTRTHHVV  614

Query: 630  EKTTLYDMDIDITQKYVAVACQDRNVRVYNTVNGKQKKCYKGSQGDEGSLLKVHVDPSGT  689
             KTTLYDMD++ + KY A+ CQDRN+R++N  +GKQKK +KGSQG++G+L+KV DPSG
Sbjct: 615  RKTTLYDMDVEPSWKYTAIGCQDRNIRIFNISSGKQKKLFKGSQGEDGTLIKVQTDPSGI  674

Query: 690  FLATSCSDKSISVIDFYSGECIAKMFGHSEIITSMKFTYDCHHLITVSGDSCVFIWHLGP  749
            ++ATSCSDK++S+ DF+SGEC+A MFGHSEI+T MKF+ DC HLI+VSGDSC+F+W L
Sbjct: 675  YIATSCSDKNLSIFDFFSGECVATMFGHSEIVTGMKFSNDCKHLISVSGDSCIFVWRLSS  734

Query: 750  EITNCMKQHLLEIDHRQ----QQQHTNDKKRSGHPRQDTYVSTPSEIHSLSPGXXXXXXX  805
            E+T M+Q L E+ RQ    QQ  T+ +K SG     V  PS     P
Sbjct: 735  EMTISMRQRLAELRQRQRGIKQQGPTSPQKASGAKQHHPPVVPPS-----GPALSSDSDK  789

Query: 806  XXXXXXXMLKTPSKDSLPDPRCLLTNGKLPL-------WAKRLLGDDDVADGSAFHAK  858
                     + P+   L   + L +G P          W     ++   G A  A
Sbjct: 790  EGEDEGTEEEELPALPILGKSTKKELASGSSPALLRSLSHWEMSRAQENMEFLGPAPTAN  849

Query: 859  RSYQPHGRWAERAGQEPLKTILDAQDLD  886
            +   GRWA+  +   ++++LD + L+
Sbjct: 850  TGPKRRGRWAQPGVELSVRSMLDLRQLE  877
```

FIG. 63B

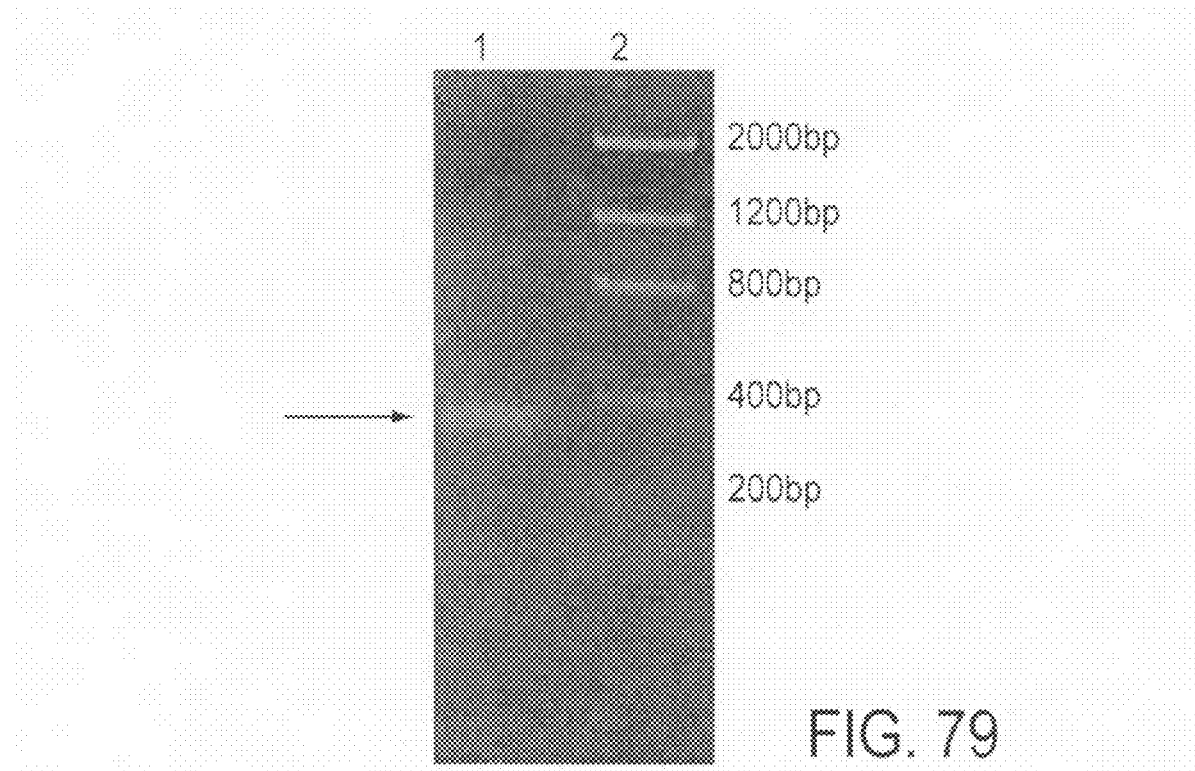

FIG. 79

TGCTGTCGCCTCCTCTGATGCGCTTGCCCTCTCCCGGCCCCGGGAC
TCCGGGAGA*ATGTGGGTCCTAGGCATCGCGGCAACTTTTTGCGGAT*
*TGTTCTTGCTTCCAGGCTTTGCGCTGCAAATCCAGTGCTACCAGTGT*
*GAAGAATTCCAGCTGAACAACGACTGCTCCTCCCCGAGTTCATTG*
*TGAATTGCACGGTGAACGTTCAAGACATGTGTCAGAAAGAAGTGAT*
*GGAGCAAAGTGCCGACACTAAAAGAACAAACACCTTGCTCTTCGA*
*GATGAGACATTTTGCCAAGCAGTTGACCACTTAG*TTCTCAAGAAGCA
ACTATCTCTTTCATGTGCCTTCTGAGG

FIG. 80

MRGSHHHHHHGMAS*MWVLGIAATFCGLFLLPGFALQIQCYQCEEF*
*QLNNDCSSPEFIVNCTVNVQDMCQKEVMEQSADTKRTNTLLFEMR*
*HFAKQLTT*

FIG. 83

GATCTCGATCCCGCGAAATTAATACGACTCACTATAGGGAGACCACAACGGTTTCCCTCTAGAA
ATAATTTTGTTTAACTTTAAGAAGGAGATATACATATGCGGGGTTCTCATCATCATCATCATG
GTATGGCTAGCATGTGGGTCCTAGGCATCGCGGCAACTTTTTGCGGATTGTTCTTGCTTCCAG
GCTTTGCGCTGCAAATCCAGTGCTACCAGTGTGAAGAATTCCAGCTGAACAACGACTGCTCC
TCCCCCGAGTTCATTGTGAATTGCACGGTGAACGTTCAAGACATGTGTCAGAAAGAAGTGAT
GGAGCAAAGTGCCGACACTAAAAGAACAAACACCTTGCTCTTCGAGATGAGACATTTTGCCA
AGCAGTTGACCACTTAG*AAGCTTGATCCGGCTGCTAACAAAGCCCGAAAGGAAGCTGAGTTG*
*GCTGCTGCCACCGCTGAGCAATAACTAGCATAACCCCTTGGGGCCTCTAAACGGGTCTTGAGG*
*GGTTTTTTGCTGAAAGGAGGAACTATATCCGGATCTGGCGTAATAGCGAAGAGGCCCGCACCG*
*ATCGCCCTTCCCAACAGTTGCGCAGCCTGAATGGCGAATGGGACGCGCCCTGTAGCGGCGCA*
*TTAAGCGCGGCGGGTGTGGTGGTTACGCGCAGCGTGACCGCTACACTTGCCAGCGCCCTAGC*
*GCCCGCTCCTTTCGCTTTCTTCCCTTCCTTTCTCGCCACGTTCGCCGGCTTTCCCCGTCAAGC*
*TCTAAATCGGGGGCTCCCTTTAGGGTTCCGATTTAGTGCTTTACGGCACCTCGACCCCAAAAA*
*CTTGATTAGGGTGATGGTTCACGTAGTGGGCCATCGCCCTGATAGACGGTTTTTCGCCCTTTGA*
*CGTTGGAGTCCACGTTCTTTAATAGTGGACTCTTGTTCCAAACTGGAACAACACTCAACCCTATC*
*TCGGTCTATTCTTTTGATTTATAAGGGATTTTGCCGATTTCGGCCTATTGGTTAAAAAATGAGCTG*
*ATTTAACAAAAATTTAACGCGAATTTTAACAAAATATTAACGCTTACAATTTAGGTGGCACTTTTCG*
*GGGAAATGTGCGCGGAACCCCTATTTGTTTATTTTTCTAAATACATTCAAATATGTATCCGCTCAT*
*GAGACAATAACCCTGATAAATGCTTCAATAATATTGAAAAAGGAAGAGTATGAGTATTCAACATTT*
*CCGTGTCGCCCTTATTCCCTTTTTTGCGGCATTTTGCCTTCCTGTTTTTGCTCACCCAGAAACG*
*CTGGTGAAAGTAAAAGATGCTGAAGATCAGTTGGGTGCACGAGTGGGTTACATCGAACTGGAT*
*CTCAACAGCGGTAAGATCCTTGAGAGTTTTCGCCCCGAAGAACGTTTTCCAATGATGAGCACTT*
*TTAAAGTTCTGCTATGTGGCGCGGTATTATCCCGTATTGACGCCGGGCAAGAGCAACTCGGTCG*
*CCGCATACACTATTCTCAGAATGACTTGGTTGAGTACTCACCAGTCACAGAAAAGCATCTTACGG*
*ATGGCATGACAGTAAGAGAATTATGCAGTGCTGCCATAACCATGAGTGATAACACTGCGGCCAA*
*CTTACTTCTGACAACGATCGGAGGACCGAAGGAGCTAACCGCTTTTTTGCACAACATGGGGGA*
*TCATGTAACTCGCCTTGATCGTTGGGAACCGGAGCTGAATGAAGCCATACCAAACGACGAGCG*
*TGACACCACGATGCCTGTAGCAATGGCAACAACGTTGCGCAAACTATTAACTGGCGAACTACTT*
*ACTCTAGCTTCCCGGCAACAATTAATAGACTGGATGGAGGCGGATAAAGTTGCAGGACCACTTC*
*TGCGCTCGGCCCTTCCGGCTGGCTGGTTTATTGCTGATAAATCTGGAGCCGGTGAGCGTGGGT*
*CTCGCGGTATCATTGCAGCACTGGGGCCAGATGGTAAGCCCTCCCGTATCGTAGTTATCTACAC*
*GACGGGGAGTCAGGCAACTATGGATGAACGAAATAGACAGATCGCTGAGATAGGTGCCTCACT*
*GATTAAGCATTGGTAACTGTCAGACCAAGTTTACTCATATATACTTTAGATTGATTTAAAACTTCAT*
*TTTTAATTTAAAAGGATCTAGGTGAAGATCCTTTTTGATAATCTCATGACCAAAATCCCTTAACGT*
*GAGTTTTCGTTCCACTGAGCGTCAGACCCCGTAGAAAAGATCAAAGGATCTTCTTGAGATCCTT*
*TTTTTCTGCGCGTAATCTGCTGCTTGCAAACAAAAAAACCACCGCTACCAGCGGTGGTTTGTTT*
*GCCGGATCAAGAGCTACCAACTCTTTTTCCGAAGGTAACTGGCTTCAGCAGAGCGCAGATACC*
*AAATACTGTTCTTCTAGTGTAGCCGTAGTTAGGCCACCACTTCAAGAACTCTGTAGCACCGCCTA*
*CATACCTCGCTCTGCTAATCCTGTTACCAGTGGCTGCTGCCAGTGGCGATAAGTCGTGTCTTAC*
*CGGGTTGGACTCAAGACGATAGTTACCGGATAAGGCGCAGCGGTCGGGCTGAACGGGGGGTT*
*CGTGCACACAGCCCAGCTTGGAGCGAACGACCTACACCGAACTGAGATACCTACAGCGTGAG*
*CTATGAGAAAGCGCCACGCTTCCCGAAGGGAGAAAGGCGGACAGGTATCCGGTAAGCGGCAG*
*GGTCGGAACAGGAGAGCGCACGAGGGAGCTTCCAGGGGGAAACGCCTGGTATCTTTATAGTC*
*CTGTCGGGTTTCGCCACCTCTGACTTGAGCGTCGATTTTTGTGATGCTCGTCAGGGGGGCGGA*
*GCCTATGGAAAAACGCCAGCAACGCGGCCTTTTTACGGTTCCTGGCCTTTTGCTGGCCTTTTG*
*CTCACATGTTCTTTCCTGCGTTATCCCCTGATTCTGTGGATAACCGTATTACCGCCTTTGAGTGA*
*GCTGATACCGCTCGCCGCAGCCGAACGACCGAGCGCAGCGAGTCAGTGAGCGAGGAAGCGG*
*AAGAGCGCCCAATACGCAAACCGCCTCTCCCCGCGCGTTGGCCGATTCATTAATGCAG*

FIG. 84

MMP11_488 DNA sequence (SEQ ID NO: 1782)
ATGAACAGCTTCAGCACCAGCGCCTTCGGCCCCGTGGCCTTCAGCCTGGGCCTGCTGCTG
GTGCTGCCTGCCGCCTTCCCTGCCCCCGTGCCCCCATGGAGCACCATCACCATCATCAC
CACCACATCCTGCGCTTCCCTTGGCAGCTGGTGCAGGAGCAGGTCCGCCAGACAATGGCC
GAGGCCCTGAAAGTGTGGAGCGACGTGACCCCCCTGACCTTCACCGAGGTGCACGAGGGA
CGCGCCGACATCATGATCGACTTCGCCCGCTACTGGCACGGCGACGACCTGCCCTTCGAC
GGCCCTGGCGGCATCCTGGCCCACGCCTTTTTCCCCAAGACCCACCGCGAGGGCGATGTG
CACTTCGACTACGACGAGACCTGGACCATCGGCGACGATCAGGGCACCGACCTGCTGCAG
GTGGCAGCCCACGAGTTCGGCCACGTGCTGGGCCTGCAGCACACCACCGCCGCCAAGGCC
CTGATGAGCGCCTTCTACACCTTCCGCTACCCCTGAGCCTGAGCCCCGATGATTGTCGC
GGCGTGCAGCACCTGTACGGCCAGCCTGGCCCACCGTGACCAGCCGCACCCCTGCCCTG
GGCCCCCAGGCCGGCATCGATACCAATGAGATCGCCCCCCTGGAGCCCGACGCCCCTCCC
GATGCCTGTGAGGCCAGCTTCGACGCCGTGTCCACCATCCGCGGCGAGCTGTTCTTCTTC
AAGGCCGGCTTTGTGTGGCGCCTGCGCGGAGGGCAGCTGCAGCCCGGCTACCCCGCCCTG
GCCAGCCGCCACTGGCAGGGCCTGCCCAGCCCTGTGGACGCCGCCTTCGAGGACGCCCAG
GGCCACATCTGGTTTTTCCAGGGCGCCCAGTATTGGGTGTACGACGGCGAGAAGCCTGTG
CTGGGCCCTGCCCCTCTGACCGAGCTGGGCCTTGTGCGCTTCCCCGTGCACGCCGCCCTT
GTGTGGGGCCCTGAAAAGAACAAGATCTACTTCTTCCGGGGACGCGACTACTGGCGCTTC
CACCCCAGCACCCGCCGCGTGGATAGCCCCGTCCCTCGCCGCGCCACCGACTGGCGCGGC
GTGCCTAGCGAGATCGATGCCGCCTTTCAGGATGCCGATGGCTACGCCTACTTCCTGCGC
GGACGGCTGTACTGGAAGTTCGACCCCGTGAAGGTGAAGGCCCTGGAGGGCTTCCCCCGC
CTTGTGGGCCCCGACTTCTTCGGCTGTGCCGAGCCTGCCAACACCTTCCTGTGATGAGTT
TAAAC<u>GCGGCCGC</u>

MMP11_354 DNA sequence (SEQ ID NO: 1783)
ATGAACAGCTTCAGCACCAGCGCCTTCGGCCCCGTGGCCTTCAGCCTGGGCCTGCTGCTG
GTGCTGCCTGCCGCCTTCCCTGCCCCCGTGCCCC<u>CCATGG</u>AGCACCACCATCACCATCAC
CACCACATCCTGCGCTTCCCTTGGCAGCTGGTGCAGGAGCAGGTCCGCCAGACAATGGCC
GAGGCCCTGAAAGTGTGGAGCGACGTGACCCCCCTGACCTTCACCGAGGTGCACGAGGGA
CGGGCCGACATCATGATCGACTTCGCCCGGTACTGGCACGGCGATGACCTGCCCTTCGAC
GGCCCTGGCGGCATCCTGGCCCACGCCTTTTTCCCCAAGACCCACCGGGAGGGCGACGTG
CACTTCGACTACGACGAGACCTGGACCATCGGCGACGACCAGGGCACCGACCTGCTGCAG
GTGGCCGCCCACGAGTTCGGCCACGTGCTGGGCCTGCAGCACACCACCGCCGCCAAGGCC
CTGATGAGCGCCTTCTACACCTTCCGCTACCCTCTGAGCCTGAGCCCCGACGACTGTCGG
GGCGTGCAGCACCTGTACGGCCAGCCCTGGCCCACCGTGACCAGCCGGACCCCTGCCCTG
GGCCCTCAGGCCGGCATCGACACCAACGAGATCGCCCCCCTGGAGCCCGACGCCCCTCCC
GATGCCTGTGAGGCCAGCTTCGACGCCGTGTCCACCATCCGGGGCGAGCTGTTCTTCTTC
AAGGCCGGCTTTGTGTGGCGGCTGCGCGGAGGGCAGCTGCAGCCCGGCTACCCCGCCCTG
GCCAGCCGGCACTGGCAGGGCCTGCCCAGCCCTGTGGACGCCGCCTTCGAGGACGCCCAG
GGCCACATCTGGTTCTTCCAGGGCACCACCGGCGTGTCCACCCCTGCCCCTGGCGTGTAA
TGAGTTTAAAC<u>GCGGCCGC</u>

FIG. 86

MMP11_488_protein sequence (SEQ ID NO: 1784)
MNSFSTSAFGPVAFSLGLLLVLPAAFPAPVPPMEHHHHHHHHILRFPWQLVQEQVRQTMAEALK
VWSDVTPLTFTEVHEGRADIMIDFARYWHGDDLPFDGPGGILAHAFFPKTHREGDVHFDYDETWT
IGDDQGTDLLQVAAHEFGHVLGLQHTTAAKALMSAFYTFRYPLSLSPDDCRGVQHLYGQPWPTV
TSRTPALGPQAGIDTNEIAPLEPDAPPDACEASFDAVSTIRGELFFFKAGFVWRLRGGQLQPGYPAL
ASRHWQGLPSPVDAAFEDAQGHIWFFQGAQYWVYDGEKPVLGPAPLTELGLVRFPVHAALVWG
PEKNKIYFFRGRDYWRFHPSTRRVDSPVPRRATDWRGVPSEIDAAFQDADGYAYFLRGRLYWKF
DPVKVKALEGFPRLVGPDFFGCAEPANTFL

MMP11_354_protein sequence (SEQ ID NO: 1785)
MNSFSTSAFGPVAFSLGLLLVLPAAFPAPVPPMEHHHHHHHHILRFPWQLVQEQVRQTMAEALK
VWSDVTPLTFTEVHEGRADIMIDFARYWHGDDLPFDGPGGILAHAFFPKTHREGDVHFDYDETWT
IGDDQGTDLLQVAAHEFGHVLGLQHTTAAKALMSAFYTFRYPLSLSPDDCRGVQHLYGQPWPTV
TSRTPALGPQAGIDTNEIAPLEPDAPPDACEASFDAVSTIRGELFFFKAGFVWRLRGGQLQPGYPAL
ASRHWQGLPSPVDAAFEDAQGHIWFFQGTTGVSTPAPGV

FIG. 87

MMP11_488 pET28 (SEQ ID NO: 1786)
MEHHHHHHHHHILRFPWQLVQEQVRQTMAEALKVWSDVTPLTFTEVHEGRADIMIDFARYWHG
DDLPFDGPGGILAHAFFPKTHREGDVHFDYDETWTIGDDQGTDLLQVAAHEFGHVLGLQHTTAA
KALMSAFYTFRYPLSLSPDDCRGVQHLYGQPWPTVTSRTPALGPQAGIDTNEIAPLEPDAPPDACE
ASFDAVSTIRGELFFFKAGFVWRLRGGQLQPGYPALASRHWQGLPSPVDAAFEDAQGHIWFFQGA
QYWVYDGEKPVLGPAPLTELGLVRFPVHAALVWGPEKNKIYFFRGRDYWRFHPSTRRVDSPVPR
RATDWRGVPSEIDAAFQDADGYAYFLRGRLYWKFDPVKVKALEGFPRLVGPDFFGCAEPANTFL

MMP11_354 pET28 (SEQ ID NO: 1787)
MEHHHHHHHHHILRFPWQLVQEQVRQTMAEALKVWSDVTPLTFTEVHEGRADIMIDFARYWHG
DDLPFDGPGGILAHAFFPKTHREGDVHFDYDETWTIGDDQGTDLLQVAAHEFGHVLGLQHTTAA
KALMSAFYTFRYPLSLSPDDCRGVQHLYGQPWPTVTSRTPALGPQAGIDTNEIAPLEPDAPPDACE
ASFDAVSTIRGELFFFKAGFVWRLRGGQLQPGYPALASRHWQGLPSPVDAAFEDAQGHIWFFQGT
TGVSTPAPGV

FIG. 90

SPLICE VARIANT SEQUENCE

MAPAAWLRSAAARALLPPMLLLLQPPPLLARALPPDVHHLHAERRGPQPWHAA
LPSSPAPAPATQEAPRPASSLRPPRCGVPDPSDGLSARNRQKRILRFPWQLVQEQV
RQTMAEALKVWSDVTPLTFTEVHEGRADIMIDFARYWHGDDLPFDGPGGILAHA
FFPKTHREGDVHFDYDETWTIGDDQGTDLLQVAAHEFGHVLGLQHTTAAKALM
SAFYTFRYPLSLSPDDCRGVQHLYGQPWPTVTSRTPALGPQAGIDTNEIAPLEPDA
PPDACEASFDAVSTIRGELFFFKAGFVWRLRGGQLQPGYPALASRHWQGLPSPVD
AAFEDAQGHIWFFQGTTGVSTPAPGV

Peptide CGEN6301 (SEQ ID NO:1781)

KEY

FIG. 93

```
CgenGRP:    MRGSELPLVLLALVLCLAPRGRAVPLPAGGGTVLTKMYPRGNHWAVGHLMGKKSTGESSS
WT GRP 1:   MRGSELPLVLLALVLCLAPRGRAVPLPAGGGTVLTKMYPRGNHWAVGHLMGKKSTGESSS
WT GRP 2:   MRGRELPLVLLALVLCLAPRGRAVPLPAGGGTVLTKMYPRGNHWAVGHLMGKKSTGESSS
WT GRP 3:   MRGRELPLVLLALVLCLAPRGRAVPLPAGGGTVLTKMYPRGNHWAVGHLMGKKSTGESSS CgenGRP:    VSERGSLKQQLREYIRWEEAARNLLGLIEAKENRNHQPPQPKALGNQQPSWDSEDSSNFK
WT GRP 1:   VSERGSLKQQLREYIRWEEAARNLLGLIEAKENRNHQPPQPKALGNQQPSWDSEDSSNFK
WT GRP 2:   VSERGSLKQQLREYIRWEEAARNLLGLIEAKENRNHQPPQPKALGNQQPSWDSEDSSNFK
WT GRP 3:   VSERGSLKQQLREYIRWEEAARNLLGLIEAKENRNHQPPQPKALGNQQPSWDSEDSSNFK CgenGRP:    DVGSKGK··DSLLQVLNVKEGTPS·················VGRLSAPGSQREGRNPQLNQQ
WT GRP 1:   DVGSKGK·························VGRLSAPGSQREGRNPQLNQQ
WT GRP 2:   D······LVDSLLQVLNVKEGTPS······················
WT GRP 3:   DVGSKGK···································GSQREGRNPQLNQQ
```

GAATTCGCCACCATGAACAGCTTCAGCACCAGCGCCTTCGGCCCTGTGGCCTTCAGCCTG
GGCCTGCTGCTGGTGCTGCCTGCCGCCTTCCCTGCCCCCGTGCCCCCCATGGAGCACCAC
CACCATCACCACCACCATAGCACCGGCGAGAGCAGCAGCGTGTCCGAGCGCGGCAGCCTG
AAGCAGCAGCTGCGCGAGTACATCCGCTGGGAGGAGGCCGCTCGCAACCTGCTGGGCCTG
ATCGAGGCCAAGGAGAACCGGAATCACCAGCCCCAGCCCCAAGGCCAACTTCAAGGATGTGGGCAGCAAA
CAGCCCAGCTGGGACAGCGAGGACAGCAGCAACTTCAAGGATGTGGGCAGCAAGGGCAAA
GTGGGCCGGCTGTCCGCCCCTGGCAGCCAGCGCGAGGGCCGGAACCCTCAGCTGAACCAG
CAGTGATGAGTTTAAACGGGCCGC

FIG. 99B

GAATTCGCCACCATGAACAGCTTCAGCACCAGCGCCTTCGGCCCTGTGGCCTTCAGCCTG
GGCCTGCTGCTGGTGCTGCCTGCCGCCTTCCCTGCCCCCGTGCCCCCCATGGAGCACCAT
CATCACCATCATCACAGCACCGGCGAGTACATCCGCTGGGAGGAGGCCGCGGCAGCCTG
AAGCAGCAGCTGCGCGAGTACATCCGCTGGGAGGAGGCCGCTCGCAACCTGCTGGGCCTG
ATCGAGGCCAAGGAGAACCGGAATCACCAGCCCCAGCCCCAAGGCCAACTTCAAGGATGTGGGCAGCAAG
CAGCCCAGCTGGGACAGCGAGGACAGCAGCAACTTCAAGGATGTGGGCAGCAAGGGCAAG
GACAGCCTGCTGCAGGTGCTGAATGTGAAGGAAGGCACCCCCAGCTAATGAGTTTAAACG
CGGCCGC

FIG. 100A

MNSFSTSAFGPVAFSLGLLLVLPAAFPAPVPPMEHHHHHHHSTGESSSV
SERGSLKQQLREYIRWEEAARNLLGLIEAKENRNHQPPQPKALGNQQPSW
DSEDSSNFKDVGSKGKVGRLSAPGSQREGRNPQLNQQ

FIG. 100B

MNSFSTSAFGPVAFSLGLLLVLPAAFPAPVPPMEHHHHHHHSTGESSSV
SERGSLKQQLREYIRWEEAARNLLGLIEAKENRNHQPPQPKALGNQQPSW
DSEDSSNFKDVGSKGKDSLLQVLNVKEGTPS

SPLICE VARIANT SEQUENCE

MRGSELPLVLLALVLCLAPRGRAVPLPAGGGTVLTKMYPRGNHWAVGHLMGKKS
TGESSSVSERGSLKQQLREYIRWEEAARNLLGLIEAKENRNHQPPQPKALGNQQ
PSWDSEDSSNFKDVGSKGKDSLLQVLNVKEGTPS

KEY             Peptide CGEN0601

FIG. 105

NUCLEOTIDE AND AMINO ACID SEQUENCES, AND ASSAYS AND METHODS OF USE THEREOF FOR DIAGNOSIS OF LUNG CANCER

CROSS-REFERENCE TO RELATED APPLICATION(S)

This application is related to Novel Nucleotide and Amino Acid Sequences, and Assays and Methods of use thereof for Diagnosis of Lung Cancer, and is a continuation-in-part of U.S. Non-provisional application Ser. No. 11/051,720 filed on Jan. 27, 2005, which claims the benefit of priority from the below U.S. Provisional Applications which are:
- Application No. 60/620,916 filed Oct. 22, 2004—Differential Expression of Markers in Colon Cancer
- Application No. 60/620,874 filed Oct. 22, 2004—Differential Expression of Markers in Ovarian Cancer
- Application No. 60/589,815 filed Jul. 22, 2004—Differential Expression of Markers in Lung Cancer
- Application No. 60/607,307 filed Sep. 7, 2004—Differential Expression of Markers in Lung Cancer
- Application No. 60/620,853 filed Oct. 22, 2004—Differential Expression of Markers in Lung Cancer
- Application No. 60/628,112 filed Nov. 17, 2004—Differential Expression of Markers in Lung Cancer II
- Application No. 60/539,129 filed Jan. 27, 2004—Methods and Systems for Annotating Biomolecular Sequences Each of the above-identified U.S. Non-provisional and U.S. Provisional Applications are incorporated herein by reference in their entirety.

FIELD OF THE INVENTION

The present invention is related to novel nucleotide and protein sequences that are diagnostic markers for lung cancer, and assays and methods of use thereof.

BACKGROUND OF THE INVENTION

Lung cancer is the primary cause of cancer death among both men and women in the U.S., with an estimated 172,000 new cases being reported in 1994. The five-year survival rate among all lung cancer patients, regardless of the stage of disease at diagnosis, is only 13%. This contrasts with a five-year survival rate of 46% among cases detected while the disease is still localized. However, only 16% of lung cancers are discovered before the disease has spread. Lung cancers are broadly classified into small cell or non-small cell lung cancers. Non-small cell lung cancers are further divided into adenocarcinomas, bronchioalveolar-alveolar, squamous cell and large cell carcinomas. Approximately, 75-85 percent of lung cancers are non-small cell cancers and 15-25 percent are small cell cancers of the lung.

Early detection is difficult since clinical symptoms are often not seen until the disease has reached an advanced stage. Currently, diagnosis is aided by the use of chest x-rays, analysis of the type of cells contained in sputum and fiberoptic examination of the bronchial passages. Treatment regimens are determined by the type and stage of the cancer, and include surgery, radiation therapy and/or chemotherapy.

Early detection of primary, metastatic, and recurrent disease can significantly impact the prognosis of individuals suffering from lung cancer. Non-small cell lung cancer diagnosed at an early stage has a significantly better outcome than that diagnosed at more advanced stages. Similarly, early diagnosis of small cell lung cancer potentially has a better prognosis.

Although current radiotherapeutic agents, chemotherapeutic agents and biological toxins are potent cytotoxins, they do not discriminate between normal and malignant cells, producing adverse effects and dose-limiting toxicities. There remains a need for lung cancer specific cancer markers. There remains a need for reagents and kits which can be used to detect the presence of lung cancer markers in samples from patients. There remains a need for methods of screening and diagnosing individuals who have lung cancer and methods of monitoring response to treatment, disease progression and disease recurrence in patients diagnosed with lung cancer. There remains a need for reagents, kits and methods for determining the type of lung cancer that an individual who has lung cancer has. There remains a need for compositions which can specifically target lung cancer cells. There remains a need for imaging agents which can specifically bind to lung cancer cells. There remains a need for improved methods of imaging lung cancer cells. There remains a need for therapeutic agents which can specifically bind to lung cancer cells. There remains a need for improved methods of treating individuals who are suspected of suffering from lung cancer.

SUMMARY OF THE INVENTION

The background art does not teach or suggest markers for lung cancer that are sufficiently sensitive and/or accurate, alone or in combination.

The present invention overcomes these deficiencies of the background art by providing novel markers for lung cancer that are both sensitive and accurate. Furthermore, these markers are able to distinguish between different types of lung cancer, such as small cell or non-small cell lung cancer, and further between non-small cell lung cancer types, such as adenocarcinomas, squamous cell and large cell carcinomas. These markers are overexpressed in lung cancer specifically, as opposed to normal lung tissue. The measurement of these markers, alone or in combination, in patient (biological) samples provides information that the diagnostician can correlate with a probable diagnosis of lung cancer. The markers of the present invention, alone or in combination, show a high degree of differential detection between lung cancer and non-cancerous states.

According to preferred embodiments of the present invention, examples of suitable biological samples which may optionally be used with preferred embodiments of the present invention include but are not limited to blood, serum, plasma, blood cells, urine, sputum, saliva, stool, spinal fluid or CSF, lymph fluid, the external secretions of the skin, respiratory, intestinal, and genitourinary tracts, tears, milk, neuronal tissue, lung tissue, any human organ or tissue, including any tumor or normal tissue, any sample obtained by lavage (for example of the bronchial system or of the breast ductal system), and also samples of in vivo cell culture constituents. In a preferred embodiment, the biological sample comprises lung tissue and/or sputum and/or a serum sample and/or a urine sample and/or any other tissue or liquid sample. The sample can optionally be diluted with a suitable eluant before contacting the sample to an antibody and/or performing any other diagnostic assay.

Information given in the text with regard to cellular localization was determined according to four different software programs: (i) tmhmm (from Center for Biological Sequence Analysis, Technical University of Denmark DTU, dpt cbs dot dtu dot dk/services/TMHMM/TMHMM2 dot 0b dot guide dot php) or (ii) tmpred (from EMBnet, maintained by the ISREC Bionformatics group and the LICR Information Technology Office, Ludwig Institute for Cancer Research, Swiss Institute of Bioinformatics, dot ch dot embnet dot org/software/TMPRED_form dot html for transmembrane region prediction; (iii) signalp hmm or (iv) signalp_nn (both from Center for Biological Sequence Analysis, Technical University of Denmark DTU, dot cbs dot dtu dot dk/services/SignalP/background/prediction dot php) for signal peptide prediction. The terms "signalp_hmmm" and "signalp_nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004; 28(3):171-8.], which predicts protein localization based on various parameters including, protein domains (e.g., prediction of transmembranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T→C", for example, means that the SNP results in a change at the position given in the table from T to C. Similarly, "M→Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence. SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:

model=sw.model
GAPEXT=0
GAPOP=100.0
MATRIX=blosum100

Information is given with regard to overexpression of a cluster in cancer based on ESTs. A key to the p values with regard to the analysis of such overexpression is as follows:

library-based statistics: P-value without including the level of expression in cell-lines (P1)

library based statistics: P-value including the level of expression in cell-lines (P2)

EST clone statistics: P-value without including the level of expression in cell-lines (SP1)

EST clone statistics: predicted overexpression ratio without including the level of expression in cell-lines (R3)

EST clone statistics: P-value including the level of expression in cell-lines (SP2)

EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at dot affymetrix dot com/products/arrays/specific/hgu133 dot affx; GeneChip Human Genome U133A 2.0 Array at dot affymetrix dot com/products/arrays/specific/hgu133av2 dot affx; and Human Genome U133 Plus 2.0 Array at dot affymetrix dot com/products/arrays/specific/hgu133plusdot affx). The probe names follow the Affymetrix naming convention. The data is available from NCBI Gene Expression Omnibus (see dot ncbi dot nlm dot nih dot gov/projects/geo/ and Edgar et al, Nucleic Acids Research, 2002, Vol. 30, No. 1 207-210). The dataset (including results) is available from dot ncbi dot nlm dot nih dot gov/geo/query/acc dot cgi?acc=GSE1133 for the Series GSE1133 database (published on March 2004); a reference to these results is as follows: Su et al (Proc Natl Acad Sci USA. 2004 Apr. 20; 101(16):6062-7. Epub 2004 April 2009). Probes designed by the present inventors are listed below.

>H61775_0_11_0   CCCCAGCTTTTATAGAGCGGC-CCAAGGAAGAATATTTCCAAGAAGTAGGG (SEQ ID NO: 204)

>M85491_0_0_25999 GACATCTTTGCATATCATGTCAGAGCTATAACATCATTGTGGAGAAGCTC (SEQ ID NO: 205)

>M85491_0_14_0 GTCATGAAAATCAACACCGAGGTGCGGAGCTTCGGACCTGTGTCCCGCAG (SEQ ID NO: 206)

>Z21368_0_0_61857 AGTTCATCCTTCTTCAGTGTGACCAGTAAATTCTTCCCATACTCTTGAAG (SEQ ID NO: 207)

>HUMGRP5E_0_0_16630 GCTGATATGGAAGTTGGGGAATCTGAATTGCCAGAGAATCTTGGGAAGAG (SEQ ID NO: 208)

>HUMGRP5E_0_2_0 TCTCATAGAAGCAAAGGAGAACAGAAACCACCAGCCACCTCAACCCAAGG (SEQ ID NO: 209)

>D56406_0_5_0 TCTGACTTTTACGGACTTGGCTTGTTAGAAGGCTGAAAGATGATGGCAGG (SEQ ID NO: 210)

>F05068_0_0_5744 ACGGGAGGGAAGGAAGGTGTGCGGGAGGAGTTCTCTGTCTCCACTCCCCT (SEQ ID NO: 211)

>F05068_0_0_5754 CAAGGGGAACTGACCGTTGGTCCCGAAGGTCTAGAAGTGAATGGGAGCAG (SEQ ID NO: 212)

>F05068_0_8_0 CTGGGCTTGGACTTCGGAGTTTTGCCATTGCCAGTGGGACGTCTGAGACT (SEQ ID NO: 213)

>F05068_0_1_5751 TCTTAGCAGGTAGGTGCCGCAGACCCTGCGGGTTAAGAGGTGGGGTGGGG (SEQ ID NO: 214)

>H38804_0_3_0 CGTAATTGCAGTGCATTTAGACAGGCATCTATTTGGACCTGTTTCTATCT (SEQ ID NO: 215)

>HSENA78_0_1_0 TGAAGAGTGTGAGGAAAACCTATGTTTGCCGCTTAAGCTTTCAGCTCAGC (SEQ ID NO: 216)

>R00299_0_8_0 CCAAGGCTCGTCTGCGCACCTTGTGTCTTGTAGGGTATGGTATGTGGGAC (SEQ ID NO: 217)

>Z44808_0_8_0 AAAAGCATGAGTTTCTGACCAGCGTTCTGGACGCGCTGTCCACGGACATG (SEQ ID NO: 218)

>Z44808_0_0_72347 ATGTTCTTAGGAGGCAAGCCAGGAGAAGCCGGGTCTGACTTTTCAGCTCA (SEQ ID NO: 219)

>Z44808_0_0_72349 TCCTCCAGACCCAAAGCCACAACCCATCGCAAGTCAAGAACACTTTCCAG (SEQ ID NO: 220)

>AA161187_0_0_433 ACCCTGGGTGGGCAAAAACGTGCTTTCCCGGACGGGGTTGAAGGGAGAA (SEQ ID NO: 221)

>AA161187_0_0_430 TGGAGACTGTTGCCCCACTCTGCAGATGCAGAAACGGAGGCTTGGCTGCT (SEQ ID NO: 222)

>R66178_0_7_0 CCAGTGTGGGTATCCTGGGAAACTCGGTTAAAAGGTGAGGCAGAGTACCAG (SEQ ID NO: 223)

>HUMPHOSLIP_0_0_18458 AAGGAAGCAGGACCAGTGGATGTGAGGCGTGGTCGAAGAACAACAGAAAG (SEQ ID NO: 224)

>HUMPHOSLIP_0_0_18487 ACAGGGGCCAGATGGTGACCCATGACCCAGCCTAAAAGGCAGCCAGAGGG (SEQ ID NO: 225)

>AI076020_0_3_0 ATCAGCACTGCCACCTACACCACGGTGCCGCGCGTGGCCTTCTACGCCGG (SEQ ID NO: 226)

>T23580_0_0_902 GTGAAACCCCATTGGCTTCATTGGCTCCTTGATTTAAACCACGCCCGGCT (SEQ ID NO: 227)

>T23580_0_0_901 TGAGTCCGTGTTATATCATCTGGTCTCATTGATAGGCGGGATAGGGAGGG (SEQ ID NO: 228)

>M79217_0_9_0 TTTGTGGAATAGCAACCCATGGTTATGGCGAGTGACCCGACGTGATCTGG (SEQ ID NO: 229)

>M62096_0_0_20588 AAGGCTTAGGTGCAAAGCCATTGGATACCATACCTGAGACCACACAGCCA (SEQ ID NO: 230)

>M62096_0_7_0 ACCAGAAGCAGCTGTCCAGACTCCGAGACGAAATTGAGGAGAAGCAGAAA (SEQ ID NO: 231)

>M78076_0_7_0 GAGAAGATGAACCCGCTGGAACAGTATGAGCGAAAGGTGAATGCGTCTGT (SEQ ID NO: 232)

>T99080_0_0_58896 AACTCACAGCAAGAGCTGTGTTCCAGTTAGCTTTGCTACCAGTTATGCAG (SEQ ID NO: 233)

>T08446_0_9_0 CATTTCCACTACGAGAACGTTGACTTTGGCCACATTCAGCTCCTGCTGTC (SEQ ID NO: 234)

>HUMCA1XIA_0_0_14909 GCTGCAATCTAAGTTTCGGAATACTTATACCACTCCAGAAATAATCCTCG (SEQ ID NO: 235)

>HUMCA1XIA_0_18_0 TTCAGAACTGTTAACATCGCTGACGGGAAGTGGCATCGGGTAGCAATCAG (SEQ ID NO: 236)

>T11628_0_9_0 ACAAGATCCCCGTGAAGTACCTGGAGTTCATCTCGGAATGCATCATCCAG (SEQ ID NO: 237)

>T11628_0_0_45174 TAAACAATCAAAGAGCATGTTGGCCTGGTCCTTTGCTAGGTACTGTAGAG (SEQ ID NO: 238)

>T11628_0_0_45161 TGCCTCGCCACAATGGCACCTGCCCTAAAATAGCTTCCCATGTGAGGGCT (SEQ ID NO: 239)

>HUMCEA_0_0_96 CAAGAGGGGTTTGGCTGAGACTTTAGGATTGTGATTCAGCTTAGAGGGAC (SEQ ID NO: 240)

>HUMCEA_0_0_15183 CCTGGTGGGAGCCCATGAGAAGCGAGTTCTCTGTGCAACGGACTTAGTAA (SEQ ID NO: 241)

>HUMCEA_0_0_15182 GCTCCCTGGAGCATCAGCATCATATTCTGGGGTGGAGTCTATCTGGTTCT (SEQ ID NO: 242)

\>HUMCEA_0_0_15168 TCCTGCCTGTCACCTGAAGTTCTAGATCATTCCCTGGACTCCACTCTATC (SEQ ID NO: 243)

\>HUMCEA_0_0_15180 TTTAACACAGGATTGGGACAGGATTCAGAGGGACACTGTGGCCCTTCTAC (SEQ ID NO: 244)

\>R35137_0_5_0 TATGTGGAGGTGGTGAACATGGACGCTGCAGTGCAGCAGCAGATGCTGAA (SEQ ID NO: 245)

\>Z25299_0_3_0 AACTCTGGCACCTTGGGCTGTGGAAGGCTCTGGAAAGTCCTTCAAAGCTG (SEQ ID NO: 246)

\>HSSTROL3_0_0_12518 ATGAGAGTAACCTCACCCGTGCACTAGTTTACAGAGCATTCACTGCCCCA (SEQ ID NO: 247)

\>HSSTROL3_0_0_12517 CAGAGATGAGAGCCTGGAGCATTGCAGATGCCAGGGACTTCACAAATGAA (SEQ ID NO: 248)

\>HSS100PCB_0_0_12280 CTCAAAATGAAACTCCCTCTCGCAGAGCACAATTCCAATTCGCTCTAAAA (SEQ ID NO: 249)

R20779_0_0_30670 CCGCGTTGCTTCTAGAGGCTGAATGCCTTTCAAATGGAGAAGGCTTCCAT (SEQ ID NO: 250)

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below:

"BONE" for "bone";
"COL" for "colon";
"EPI" for "epithelial";
"GEN" for "general";
"LIVER" for "liver";
"LUN" for "lung";
"LYMPH" for "lymph nodes";
"MARROW" for "bone marrow";
"OVA" for "ovary";
"PANCREAS" for "pancreas";
"PRO" for "prostate";
"STOMACH" for "stomach";
"TCELL" for "T cells";
"THYROID" for "Thyroid";
"MAM" for "breast";
"BRAIN" for "brain";
"UTERUS" for "uterus";
"SKIN" for "skin";
"KIDNEY" for "kidney";
"MUSCLE" for "muscle";
"ADREN" for "adrenal";
"HEAD" for "head and neck";
"BLADDER" for "bladder";

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "lung cancer" refers to cancers of the lung including small cell lung cancer and non-small cell lung cancer, including but not limited to lung adenocarcinoma, squamous cell carcinoma, and adenocarcinoma.

The term "marker" in the context of the present invention refers to a nucleic acid fragment, a peptide, or a polypeptide, which is differentially present in a sample taken from subjects (patients) having lung cancer (or one of the above indicative conditions) as compared to a comparable sample taken from subjects who do not have lung cancer (or one of the above indicative conditions).

The phrase "differentially present" refers to differences in the quantity of a marker present in a sample taken from patients having lung cancer (or one of the above indicative conditions) as compared to a comparable sample taken from patients who do not have lung cancer (or one of the above indicative conditions). For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be effected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of lung cancer (or one of the above indicative conditions). A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with lung cancer (or one of the above indicative conditions) or a person without lung cancer (or one of the above indicative conditions). A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxide, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

Unless otherwise noted, all experimental data relates to variants of the present invention, named according to the segment being tested (as expression was tested through RT-PCR as described).

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

According to preferred embodiments of the present invention, there is provided an isolated polynucleotide comprising SEQ ID NOs: 1 and 2.

According to preferred embodiments of the present invention, there is provided an isolated polynucleotide comprising SEQ ID NOs: 1022, 1023, 1024, 1025, 1026 and 1027.

According to preferred embodiments of the present invention, there is provided an isolated polypeptide comprising SEQ ID NOs: 1281 and 1282.

According to preferred embodiments of the present invention, there is provided an isolated polynucleotide comprising SEQ ID NOs: 3 and 4.

According to preferred embodiments of the present invention, there is provided an isolated polynucleotide comprising SEQ ID NOs: 1028, 1029, 1030, 1031, 1032, 1033, 1034, 1035, 1036, 1037 and 1038.

According to preferred embodiments of the present invention, there is provided an isolated polypeptide comprising SEQ ID NOs: 1283 and 1284.

According to preferred embodiments of the present invention, there is provided an isolated polynucleotide comprising SEQ ID NOs: 5, 6, 7 and 8.

According to preferred embodiments of the present invention, there is provided an isolated polynucleotide comprising SEQ ID NOs: 1039, 1040, 1041, 1042, 1043, 1044, 1045, 1046, 1047, 1048, 1049, 1050, 1051, 1052, 1053, 1054, 1055, 1056, 1057, 1058, 1059, 1060, 1061, 1062, 1063, 1064, 1065 and 1066.

According to preferred embodiments of the present invention, there is provided an isolated polypeptide comprising SEQ ID NOs: 1285, 1286, 1287 and 1288.

According to preferred embodiments of the present invention, there is provided an isolated polynucleotide comprising SEQ ID NOs: 9, 10, 11, 12, 13, 14 and 15.

According to preferred embodiments of the present invention, there is provided an isolated polynucleotide comprising SEQ ID NOs: 1067, 1068, 1069, 1070, 1071, 1072, 1073, 1074, 1075, 1076, 1077, 1078, 1079, 1080, 1081, 1082, 1083, 1084, 1085, 1086, 1087, 1088, 1089, 1090, 1091, 1092, 1093, 1094, 1095, 1096, 1097, 1098, 1099 and 1100.

According to preferred embodiments of the present invention, there is provided an isolated polypeptide comprising SEQ ID NOs 1289, 1290, 1291, 1292, 1293 and 1294.

According to preferred embodiments of the present invention, there is provided an isolated polynucleotide comprising SEQ ID NOs: 20 and 21.

According to preferred embodiments of the present invention, there is provided an isolated polynucleotide comprising SEQ ID NOs: 1130, 1131, 1132, 1133 and 1134.

According to preferred embodiments of the present invention, there is provided an isolated polypeptide comprising SEQ ID NOs: 1299 and 1300.

According to preferred embodiments of the present invention, there is provided an isolated polynucleotide comprising SEQ ID NOs: 22, 23 and 24.

According to preferred embodiments of the present invention, there is provided an isolated polynucleotide comprising SEQ ID NOs: 1135, 1136, 1137, 1138, 1139, 1140, 1141, 1142, 1143 and 1144.

According to preferred embodiments of the present invention, there is provided an isolated polypeptide comprising SEQ ID NOs 1301, 1302 and 1303.

According to preferred embodiments of the present invention, there is provided an isolated polynucleotide comprising SEQ ID NOs: 25, 26 and 27.

According to preferred embodiments of the present invention, there is provided an isolated polynucleotide comprising SEQ ID NOs: 1145, 1146, 1147, 1148, 1149, 1150, 1151, 1152, 1153, 1154, 1155 and 1156.

According to preferred embodiments of the present invention, there is provided an isolated polypeptide comprising SEQ ID NOs 1304 and 1305.

According to preferred embodiments of the present invention, there is provided an isolated polynucleotide comprising SEQ ID NOs: 28.

According to preferred embodiments of the present invention, there is provided an isolated polynucleotide comprising SEQ ID NOs: 1157, 1158, 1159, 1160, 1161, 1162, 1163, 1164, 1165, 1166, 1167, 1168, 1169, 1170 and 1171.

According to preferred embodiments of the present invention, there is provided an isolated polypeptide comprising SEQ ID NO: 1306.

According to preferred embodiments of the present invention, there is provided an isolated polynucleotide comprising SEQ ID NOs: 29 and 30.

According to preferred embodiments of the present invention, there is provided an isolated polynucleotide comprising SEQ ID NOs: 1172, 1173, 1174, 1175, 1176, 1177, 1178, 1179, 1180, 1181, 1182, 1183, 1184, 1185, 1186, 1187, 1188, 1189, 1190 and 1191.

According to preferred embodiments of the present invention, there is provided an isolated polypeptide comprising SEQ ID NOs 1307 and 1308.

According to preferred embodiments of the present invention, there is provided an isolated polynucleotide comprising SEQ ID NOs: 31.

According to preferred embodiments of the present invention, there is provided an isolated polynucleotide comprising SEQ ID NOs: 1192, 1193, 1194, 1195, 1196, 1197 and 1198.

According to preferred embodiments of the present invention, there is provided an isolated polypeptide comprising SEQ ID NO: 1309.

According to preferred embodiments of the present invention, there is provided an isolated polynucleotide comprising SEQ ID NOs: 32.

According to preferred embodiments of the present invention, there is provided an isolated polynucleotide comprising SEQ ID NOs: 1199, 1200, 1201, 1202, 1203, 1204, 1205, 1206, 1207, 1208, 1209, 1210, 1211, 1212, 1213, 1214 and 1215.

According to preferred embodiments of the present invention, there is provided an isolated polypeptide comprising SEQ ID NO. 1310.

According to preferred embodiments of the present invention, there is provided an isolated polynucleotide comprising SEQ ID NOs: 33.

According to preferred embodiments of the present invention, there is provided an isolated polynucleotide comprising SEQ ID NOs: 1216 and 1217, 1218, 1219, 1220, 1221, 1222, 1223, 1224, 1225, 1226 and 1227.

According to preferred embodiments of the present invention, there is provided an isolated polypeptide comprising SEQ ID NO: 1311.

According to preferred embodiments of the present invention, there is provided an isolated polynucleotide comprising SEQ ID NOs: 34.

According to preferred embodiments of the present invention, there is provided an isolated polynucleotide comprising SEQ ID NOs: 1228, 1229, 1230, 1231, 1232 and 1223.

According to preferred embodiments of the present invention, there is provided an isolated polypeptide comprising SEQ ID NO: 1312.

According to preferred embodiments of the present invention, there is provided an isolated polynucleotide comprising SEQ ID NOs: 35.

According to preferred embodiments of the present invention, there is provided an isolated polynucleotide comprising SEQ ID NOs: 1234, 1235, 1236, 1237, 1238, 1239, 1240, 1241, 1242, 1243, 1244, 1245, 1246, 1247, 1248, 1249, 1250, 1251, 1252, 1253 and 1254.

According to preferred embodiments of the present invention, there is provided an isolated polypeptide comprising SEQ ID NO: 1313.

According to preferred embodiments of the present invention, there is provided an isolated polynucleotide comprising SEQ ID NOs: 36, 37, 38, 39 and 40.

According to preferred embodiments of the present invention, there is provided an isolated polynucleotide comprising SEQ ID NOs: 1255, 1256, 1257, 1258, 1259, 1260, 1261, 1262, 1263, 1264, 1265, 1266, 1267, 1268, 1269, 1270, 1271, 1272, 1273, 1274 and 1275.

According to preferred embodiments of the present invention, there is provided an isolated polypeptide comprising SEQ ID NOs 1314, 1315, 1316 and 1317.

According to preferred embodiments of the present invention, there is provided an isolated polynucleotide comprising SEQ ID NOs: 125, 126, 127, 128, 129 and 130.

According to preferred embodiments of the present invention, there is provided an isolated polynucleotide comprising SEQ ID NOs: 887, 888, 889, 890, 891, 892, 893, 894, 895, 896, 897, 898, 899, 900, 901 and 902.

According to preferred embodiments of the present invention, there is provided an isolated polypeptide comprising SEQ ID NOs: 1394, 1395, 1396, 1397 and 1398.

According to preferred embodiments of the present invention, there is provided an isolated polynucleotide comprising a transcript SEQ ID NOs: 131 and 132.

According to preferred embodiments of the present invention, there is provided an isolated polynucleotide comprising SEQ ID NOs: 903, 904, 905, 906, 907, 907, 908 and 909.

According to preferred embodiments of the present invention, there is provided an isolated polypeptide comprising SEQ ID NOs 1399 and 1400.

According to preferred embodiments of the present invention, there is provided an isolated polynucleotide comprising SEQ ID NOs: 99, 100, 101 and 102.

According to preferred embodiments of the present invention, there is provided an isolated polynucleotide comprising SEQ ID NOs: 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787 and 788.

According to preferred embodiments of the present invention, there is provided an isolated polypeptide comprising SEQ ID NOs 1372, 1373, 1374 and 1375.

According to preferred embodiments of the present invention, there is provided an isolated polynucleotide comprising SEQ ID NOs: 134.

According to preferred embodiments of the present invention, there is provided an isolated polynucleotide comprising SEQ ID NOs: 913, 914, 915, 916, 917, 918, 919, 920, 921, 922, 923, 924, 925, 926, 927, 928, 929, 930, 931, 932, 933, 934, 935 and 936.

According to preferred embodiments of the present invention, there is provided an isolated polypeptide comprising SEQ ID NO: 1402.

According to preferred embodiments of the present invention, there is provided an isolated polynucleotide comprising SEQ ID NO: 133.

According to preferred embodiments of the present invention, there is provided an isolated polynucleotide comprising SEQ ID NOs: 910, 911 and 912.

According to preferred embodiments of the present invention, there is provided an isolated polynucleotide comprising SEQ ID NOs: 141, 142 and 142.

According to preferred embodiments of the present invention, there is provided an isolated polynucleotide comprising SEQ ID NOs: 961, 962, 963, 964, 965, 966, 967, 968, 969, 970, 971, 972, 973, 974, 975, 976, 977, 978, 979, 980, 981, 982, 983, 984, 985, 986, 987, 988, 989 and 990.

According to preferred embodiments of the present invention, there is provided an isolated polypeptide comprising:
Protein Name
HUMOSTRO_PEA_1_PEA_1_P21 (SEQ ID NO:1627)
HUMOSTRO_PEA_1_PEA_1_P25 (SEQ ID NO:1628)
HUMOSTRO_PEA_1_PEA_1_P30 (SEQ ID NO:1629)

According to preferred embodiments of the present invention, there is provided an isolated polynucleotide comprising SEQ ID NOs: 51, 52, 53, 54, 55, 56 and 57.

According to preferred embodiments of the present invention, there is provided an isolated polynucleotide comprising SEQ ID NOs: 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 568, 569 and 570.

According to preferred embodiments of the present invention, there is provided an isolated polypeptide comprising SEQ ID NOs 1327, 1328, 1329, 1330, 1331, 1332 and 1333.

According to preferred embodiments of the present invention, there is provided an isolated polynucleotide comprising SEQ ID NOs: 135, 136, 137, 138, 139 and 140.

According to preferred embodiments of the present invention, there is provided an isolated polynucleotide comprising SEQ ID NOs: 937, 938, 939, 940, 941, 942, 943, 944, 945, 946, 947, 948, 949, 950, 951, 952, 953, 954, 955, 956, 957, 958, 959 and 960.

According to preferred embodiments of the present invention, there is provided an isolated polypeptide comprising SEQ ID NOs 1403, 1404, 1405, 1406, 1407 and 1408.

According to preferred embodiments of the present invention, there is provided an isolated polynucleotide comprising SEQ ID NOs: 41, 42, 43, 44, 45, 46 and 47.

According to preferred embodiments of the present invention, there is provided an isolated polynucleotide comprising SEQ ID NOs: 482, 483, 484, 495, 486, 487, 488, 489, 490, 491, 492, 493, 494, 495, 496, 497, 498, 499, 500 and 501.

According to preferred embodiments of the present invention, there is provided an isolated polypeptide comprising SEQ ID NOs: 1318, 1319, 1320, 1321, 1322 and 1323.

According to preferred embodiments of the present invention, there is provided an isolated polynucleotide comprising SEQ ID NOs: 121, 122, 123 and 124.

According to preferred embodiments of the present invention, there is provided an isolated polynucleotide comprising SEQ ID NOs: 876, 877, 878, 879, 880, 881, 882, 883, 884, 885 and 886.

According to preferred embodiments of the present invention, there is provided an isolated polypeptide comprising SEQ ID NOs: 1390, 1391, 1392 and 1393.

According to preferred embodiments of the present invention, there is provided an isolated polynucleotide comprising SEQ ID NOs: 48, 49 and 50.

According to preferred embodiments of the present invention, there is provided an isolated polynucleotide comprising SEQ ID NOs: 502, 503, 504, 505, 506, 507, 508, 509, 510, 511, 512, 513, 514, 515, 516 and 517.

According to preferred embodiments of the present invention, there is provided an isolated polypeptide comprising SEQ ID NOs: 1324, 1325 and 1326.

According to preferred embodiments of the present invention, there is provided an isolated polynucleotide comprising SEQ ID NOs: 1464 and 1465.

According to preferred embodiments of the present invention, there is provided an isolated polynucleotide comprising a SEQ ID NOs: 1276, 1277, 1278, 1279 and 1280.

According to preferred embodiments of the present invention, there is provided an isolated polypeptide comprising SEQ ID NO: 1415.

Protein Name Corresponding Transcript(s)
HSU33147_PEA_1_P5   HSU33147_PEA_1_1_T1 (SEQ ID NO:1464); HSU33147_PEA_1_T2 (SEQ ID NO:1465)

According to preferred embodiments of the present invention, there is provided an isolated polynucleotide comprising SEQ ID NO: 58.

According to preferred embodiments of the present invention, there is provided an isolated polynucleotide comprising SEQ ID NOs: 571, 572, 573, 574, 575, 576, 577 and 578.

According to preferred embodiments of the present invention, there is provided an isolated polypeptide comprising SEQ ID NO: 1334.

According to preferred embodiments of the present invention, there is provided an isolated polynucleotide comprising SEQ ID NOs: 74, 75, 76, 77, 78, 79, 80, 81 and 82.

According to preferred embodiments of the present invention, there is provided an isolated polynucleotide comprising SEQ ID NOs: 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692 and 693.

According to preferred embodiments of the present invention, there is provided an isolated polypeptide comprising SEQ ID NOs 1350, 1351, 1352, 1353, 1354, 1355, 1356 and 1357.

According to preferred embodiments of the present invention, there is provided an isolated polynucleotide comprising SEQ ID NOs:
Transcript Name
T23580_T10 (SEQ ID NO:1626)

According to preferred embodiments of the present invention, there is provided an isolated polynucleotide comprising SEQ ID NOs: 579, 580, 581, 582 and 583.

According to preferred embodiments of the present invention, there is provided an isolated polypeptide comprising SEQ ID NOs 1335.

According to preferred embodiments of the present invention, there is provided an isolated polynucleotide comprising SEQ ID NOs: 59, 60, 61, 62, 63 and 64.

According to preferred embodiments of the present invention, there is provided an isolated polynucleotide comprising SEQ ID NOs: 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614 and 615.

According to preferred embodiments of the present invention, there is provided an isolated polypeptide comprising SEQ ID NOs: 1336, 1337, 1338, 1339 and 1340.

According to preferred embodiments of the present invention, there is provided an isolated polynucleotide comprising SEQ ID NOs: 65, 66, 67, 68, 69, 70, 71, 72 and 73.

According to preferred embodiments of the present invention, there is provided an isolated polynucleotide comprising SEQ ID NOs: 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658 and 659.

According to preferred embodiments of the present invention, there is provided an isolated polypeptide comprising SEQ ID NOs: 1341, 1342, 1343, 1344, 1345, 1346, 1347, 1348 and 1349.

According to preferred embodiments of the present invention, there is provided an isolated polynucleotide comprising SEQ ID NOs: 83, 84, 85, 86, 87, 88, 89, 90, 91, 92, 93, 94, 95 and 96.

According to preferred embodiments of the present invention, there is provided an isolated polynucleotide comprising SEQ ID NOs: 695, 696, 697, 698, 699, 700, 701, 702, 703, 704 and 705.

According to preferred embodiments of the present invention, there is provided an isolated polypeptide comprising SEQ ID NOs 1358, 1359, 1360, 1361, 1362, 1363, 1364, 1365, 1366, 1367, 1368 and 1369.

According to preferred embodiments of the present invention, there is provided an isolated polynucleotide comprising SEQ ID NOs: 97 and 98.

According to preferred embodiments of the present invention, there is provided an isolated polynucleotide comprising SEQ ID NOs: 706, 707, 708, 709, 710, 711, 712, 713, 714, 715, 716, 717, 718, 719, 720, 721, 722, 723, 724, 725, 726, 727, 728, 729, 730, 731, 732, 733, 734, 735, 736, 737, 738, 739, 740 and 741.

According to preferred embodiments of the present invention, there is provided an isolated polypeptide comprising SEQ ID NOs: 1370 and 1371.

According to preferred embodiments of the present invention, there is provided an isolated polynucleotide comprising SEQ ID NOs: 103, 104, 105, 106, 107 and 108.

According to preferred embodiments of the present invention, there is provided an isolated polynucleotide comprising SEQ ID NOs: 789, 790, 791, 792, 793, 794, 795, 796, 797, 798, 799, 800, 801, 802, 803, 804, 805, 806, 807, 808, 809, 810, 811, 812 and 813.

According to preferred embodiments of the present invention, there is provided an isolated polypeptide comprising SEQ ID NOs: 1376, 1377, 1378 and 1379.

According to preferred embodiments of the present invention, there is provided an isolated polynucleotide comprising SEQ ID NOs: 114, 115, 116, 117, 118 and 119.

According to preferred embodiments of the present invention, there is provided an isolated polynucleotide comprising SEQ ID NOs: 856, 857, 858, 859, 860, 861, 862, 863, 864, 865, 866, 867, 868, 869, 870, 871, 872, 873, 874 and 875.

According to preferred embodiments of the present invention, there is provided an isolated polypeptide comprising SEQ ID NOs: 1385, 1386, 1387, 1388 and 1389.

According to preferred embodiments of the present invention, there is provided an isolated polynucleotide comprising SEQ ID NOs: 144, 145, 146, 147, 148 and 149.

According to preferred embodiments of the present invention, there is provided an isolated polynucleotide comprising SEQ ID NOs: 991, 992, 993, 994, 995, 996, 997, 998, 999, 1000, 1001, 1002, 1003, 1004, 1005, 1006, 1007, 1008, 1009, 1010, 1011, 1012, 1013, 1014, 1015 and 1016.

According to preferred embodiments of the present invention, there is provided an isolated polypeptide comprising SEQ ID NOs: 1409, 1410, 1411, 1412 and 1413.

According to preferred embodiments of the present invention, there is provided an isolated polynucleotide comprising SEQ ID NO: 150.

According to preferred embodiments of the present invention, there is provided an isolated polynucleotide comprising SEQ ID NOs: 1017, 1018, 1019, 1020 and 1021.

According to preferred embodiments of the present invention, there is provided an isolated polypeptide comprising SEQ ID NO: 1414.

According to preferred embodiments of the present invention, there is provided an isolated polynucleotide comprising SEQ ID NOs: 109, 110, 111, 112 and 113.

According to preferred embodiments of the present invention, there is provided an isolated polynucleotide comprising SEQ ID NOs: 814, 815, 816, 817, 818, 819, 820, 821, 822, 823, 824, 825, 826, 827, 829, 830, 831, 832, 833, 834, 835, 836, 837, 838, 839, 840, 841, 842, 843, 844, 845, 846, 847, 848, 849, 850, 851, 852, 853, 854 and 855.

According to preferred embodiments of the present invention, there is provided an isolated polypeptide comprising SEQ ID NOs 1380, 1381, 1382, 1383 and 1384.

According to preferred embodiments of the present invention, there is provided an isolated chimeric polypeptide encoding for HSSTROL3_P4 (SEQ ID NO:1394), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARNRQKRF-VLSGGRWEKTDLTYRILRFPWQLVQEQVRQTMAE-ALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P4 (SEQ ID NO:1394), a bridging amino acid H corresponding to amino acid 164 of HSSTROL3_P4 (SEQ ID NO:1394), a second amino acid sequence being at least 90% homologous to GDDLPFDGPGGILAHAFFPKTHREGD-VHFDYDETWTIGDDQGTDLLQVAAHEFGHVL-GLQHTTAAKALM SAFYTFRYPLSLSPDDCRGVQH-LYGQPWPTVTSRTPALGPQAGIDTNEIAPLEPDAPPD-ACEASFDAVSTIR GELFFFKAGFVWRLRGGQLQPGY-PALASRHWQGLPSPVDAAFEDAQGHIW-FFQGAQYWVYDGEKPVLG PAPLTELGLVRF-PVHAALVWGPEKNKIYFFRGRDYWRFHPSTRRVDSP-VPRRATDWRGVPSEIDAAFQDA DG corresponding to amino acids 165-445 of MM11_HUMAN (SEQ ID NO:1455), which also corresponds to amino acids 165-445 of HSSTROL3 P4 (SEQ ID NO: 1394), and a third amino acid sequence being at least 70%, optionally at least 80%, preferably at least 85%, more preferably at least 90% and most preferably at least 95% homologous to a polypeptide having the sequence ALGVRQLVGGGHSSRFSHLVVAGL-PHACHRKSGSSSQVLCPEPSALLSVAG (SEQ ID NO: 251) corresponding to amino acids 446-496 of HSSTROL3_P4 (SEQ ID NO:1394), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P4 (SEQ ID NO:1394), comprising a polypeptide being at least 70%, optionally at least about 80%, preferably at least about 85%, more preferably at least about 90% and most preferably at least about 95% homologous to the sequence ALGVRQLVGGGHSSRFSHLVVAGL-PHACHRKSGSSSQVLCPEPSALLSVAG (SEQ ID NO: 251) in HSSTROL3_P4 (SEQ ID NO:1394).

According to preferred embodiments of the present invention, there is provided an isolated chimeric polypeptide encoding for HSSTROL3_P5 (SEQ ID NO:1395), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARN-RQKRFVLSGGRWEKTDLTYRILRFPWQLVQEQVRQ-TMAEALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P5 (SEQ ID NO:1395), a bridging amino acid H corresponding to amino acid 164 of HSSTROL3_P5 (SEQ ID NO:1395), a second amino acid sequence being at least 90% homologous to GDDLPFDG-PGGILAHAFFPKTHREGDVHFDYDETWTIGDDQG-DLLQVAAHEFGHVLGLQHTTAAKALM SAFYTFRY-PLSLSPDDCRGVQHLYGQPWPTVTSRTPALGPQAG-IDTNEIAPLEPDAPPDACEASFDAVS-TIR GELFFFK-AGFVWRLRGGQLQPGYPALASRHWQGLPSPVDA-AFEDAQGHIWFFQ corresponding to amino acids 165-358 of MM11_HUMAN (SEQ ID NO:1455), which also corresponds to amino acids 165-358 of HSSTROL3_P5 (SEQ ID NO:1395), and a third amino acid sequence being at least 70%, optionally at least 80%, preferably at least 85%, more preferably at least 90% and most preferably at least 95% homologous to a polypeptide having the sequence ELGF-PSSTGRDESLEHCRCQGLHK (SEQ ID NO: 252) corresponding to amino acids 359-382 of HSSTROL3_P5 (SEQ ID NO:1395), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P5 (SEQ ID NO:1395), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO: 252) in HSSTROL3_P5 (SEQ ID NO:1395).

According to preferred embodiments of the present invention, there is provided an isolated chimeric polypeptide encoding for HSSTROL3_P7 (SEQ ID NO:1396), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARNRQKRF-VLSGGRWEKTDLTYRILRFPWQLVQEQVRQTMAE-ALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P7 (SEQ ID NO:1396), a bridging amino acid H corresponding to amino acid 164 of HSSTROL3_P7 (SEQ ID NO:1396), a second amino acid sequence being at least 90% homologous to GDDLPFDGPGGILAHAFFPKTHREGD-VHFDYDETWTIGDDQGTDLLQVAAHEF-GHVLGLQHTTAAKALM SAFYTFRYPLSLSPDDCR-GVQHLYGQPWPTVTSRTPALGPQAGIDT-NEIAPLEPDAPPDACEASFDAVSTIR GELFFFKAG-FVWRLRGGQLQPGYPALAS-RHWQGLPSPVDAAFEDAQGHIWFFQG corresponding to amino acids 165-359 of MM11_HUMAN (SEQ ID NO:1455), which also corresponds to amino acids 165-359 of HSSTROL3_P7 (SEQ ID NO:1396), and a third amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 360-370 of HSSTROL3_P7

(SEQ ID NO:1396), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P7 (SEQ ID NO:1396), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P7 (SEQ ID NO:1396).

According to preferred embodiments of the present invention, there is provided an isolated chimeric polypeptide encoding for HSSTROL3_P8 (SEQ ID NO:1397), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARN-RQKRFVLSGGRWEKTDLTYRILRFPWQLVQEQVRQ-TMAEALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P8 (SEQ ID NO:1397), a bridging amino acid H corresponding to amino acid 164 of HSSTROL3_P8 (SEQ ID NO:1397), a second amino acid sequence being at least 90% homologous to GDDLPFDG-PGGILAHAFFPKTHREGDVHFDYDETWTIGDDQG-TDLLQVAAHEFGHVLGLQHTTAAKALM SAFYTFRY-PLSLSPDDCRGVQHLYGQPWPTVTSRTPALGPQ-AGIDTNEIAPLE corresponding to amino acids 165-286 of MM11_HUMAN (SEQ ID NO:1455), which also corresponds to amino acids 165-286 of HSSTROL3_P8 (SEQ ID NO:1397), and a third amino acid sequence being at least 70%, optionally at least 80%, preferably at least 85%, more preferably at least 90% and most preferably at least 95% homologous to a polypeptide having the sequence VRP-CLPVPLLLCWPL (SEQ ID NO: 254) corresponding to amino acids 287-301 of HSSTROL3_P8 (SEQ ID NO:1397), wherein said first amino acid sequence, bridging amino acid, second amino acid sequence and third amino acid sequence are contiguous and in a sequential order.

According to preferred embodiments of the present invention, there is provided an isolated polypeptide encoding for a tail of HSSTROL3_P8 (SEQ ID NO:1397), comprising a polypeptide being at least 70%, optionally at least about 80%, preferably at least about 85%, more preferably at least about 90% and most preferably at least about 95% homologous to the sequence VRPCLPVPLLLCWPL (SEQ ID NO: 254) in HSSTROL3_P8 (SEQ ID NO:1397).

According to preferred embodiments of the present invention, there is provided an isolated chimeric polypeptide encoding for HSSTROL3_P9 (SEQ ID NO:1398), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARNRQK corresponding to amino acids 1-96 of MM11_HUMAN (SEQ ID NO:1455), which also corresponds to amino acids 1-96 of HSSTROL3_P9 (SEQ ID NO:1398), a second amino acid sequence being at least 90% homologous to RILRFP-WQLVQEQVRQTMAEALKVWSDVTPLT-FTEVHEGRADIMIDFARYW corresponding to amino acids 113-163 of MM11_HUMAN (SEQ ID NO:1455), which also corresponds to amino acids 97-147 of HSSTROL3_P9 (SEQ ID NO:1398), a bridging amino acid H corresponding to amino acid 148 of HSSTROL3_P9 (SEQ ID NO:1398), a third amino acid sequence being at least 90% homologous to GDDLPFDGPGGILAHAFFPKTHREGD-VHFDYDETWTIGDDQGTDLLQVAAHEF-GHVLGLQHTTAAKALM SAFYTFRYPLSLSPD-DCRGVQHLYGQPWPTVTSRTPALGPQAGIDTNEIAP-LEPDAPPDACEASFDAVSTIR GELFFFKAGFVWRL-RGGQLQPGYPALASRHWQGLPSPVDAAFEDAQGH-IWFFQG corresponding to amino acids 165-359 of MM11_HUMAN (SEQ ID NO:1455), which also corresponds to amino acids 149-343 of HSSTROL3_P9 (SEQ ID NO:1398), and a fourth amino acid sequence being at least 70%, optionally at least 80%, preferably at least 85%, more preferably at least 90% and most preferably at least 95% homologous to a polypeptide having the sequence TTGVST-PAPGV (SEQ ID NO: 253) corresponding to amino acids 344-354 of HSSTROL3_P9 (SEQ ID NO:1398), wherein said first amino acid sequence, second amino acid sequence, bridging amino acid, third amino acid sequence and fourth amino acid sequence are contiguous and in a sequential order.

According to preferred embodiments of the present invention, there is provided an isolated chimeric polypeptide encoding for an edge portion of HSSTROL3_P9 (SEQ ID NO:1398), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n−2)−x), in which x varies from 0 to n−2.

According to preferred embodiments of the present invention, there is provided an isolated polypeptide encoding for a tail of HSSTROL3_P9 (SEQ ID NO:1398), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P9 (SEQ ID NO:1398).

According to preferred embodiments of the present invention, there is provided an isolated chimeric polypeptide encoding for HUMCA1XIA_P14 (SEQ ID NO:1372), comprising a first amino acid sequence being at least 90% homologous to MEPWSSRWKTKRWLWDFTVTTLALT-FLFQAREVRGAAPVDVLKALDF-HNSPEGISKTTGFCTNRKNSKG SDTAYRVSKQAQL-SAPTKQLFPGGTFPEDFSILFTVKPKKGIQSFLLSIYN-EHGIQQIGVEVGRSPVFLFEDH TGKPAPEDY-PLFRTVNIADGKWHRVAISVEKKTVT-MIVDCKKKTTKPLDRSERAIVDTNGITVFGTRILDE EVFEGDIQQFLITGDPKAAYDYCEHYSP-DCDSSAPKAAQAQEPQIDEYAPEDIIEY-DYEYGEAEYKEAESVT EGPTVTEETIAQTEANIVD-DFQEYNYGTMESYQTEAPRHVSGTNEPNPVEEIFTE-EYLTGEDYDSQRKNSE DTLYENKEIDGRDS-DLLVDGDLGEYDFYEYKEYEDKPTSPP-NEEFGPGVPAETDITETSINGHGAYGEKGQ KGEPAVVEPGMLVEGPPGPAGPAGIMGP-PGLQGPTGPPGDPGDRGPPGRPGLPGAD-GLPGPPGTMLMLPF RYGGDGSKGPTI-SAQEAQAQAILQQARIALRGPPGPMGLTGRPGPVGG-PGSSGAKGESGDPGPQGPRGVQ GPPGPTGK-PGKRGRPGADGGRGMPGEPGAKGDRG-FDGLPGLPGDKGHRGERGPQGPPGPPGDDGMRGE DGEIGPRGLPGEAGPRGLLGPRGTP- GAPGQPGMAGVDGPPGPKGNMGPQGEPG-PPGQQGNPGPQGLPGPQ GPIGPPGEKGPQGKPGLA-GLPGADGPPGHPGKEGQSGEKGALGPPGPQGPIGYP-GPRGVKGADGVRGLKG SKGEKGEDGFPGFKGD-MGLKGDRGEVGQIGPRGEDGPEGP-KGRAGPTGDPGPSGQAGEKGKLGVPGLPG YPGRQG-PKGSTGFPGFPGANGEKGARGVAGKPGPRGQRGPT-GPRGSRGARGPTGKPGPKGTSGGDGPPGP PGERG-PQGPQGPVGFPGPKGPPGPPGKDGLPGHPGQRGET-GFQGKTGPPGPGGVVGPQGPTGETGPIGERG HPGP-PGPPGEQGLPGAAGKEGAKGDPGPQGISGKDGPAG-LRGFPGERGLPGAQGAPGLKGGEGPQGPPGP V corresponding to amino acids 1-1056 of CA1B_HUMAN_V5 (SEQ ID NO:1447), which also corresponds to amino acids 1-1056 of HUMCA1XIA_P14 (SEQ ID NO:1372), and a second amino acid sequence being at least 70%, optionally at least 80%, preferably at least 85%, more preferably at least 90% and most preferably at least 95% homologous to a polypeptide having the sequence VSMMIINSQTIMV-VNYSSSFITLML (SEQ ID NO: 256) corresponding to amino acids 1057-1081 of HUMCA1XIA_P14 (SEQ ID NO:1372), wherein said first amino acid sequence and second amino acid sequence are contiguous and in a sequential order.

According to preferred embodiments of the present invention, there is provided an isolated polypeptide encoding for a tail of HUMCA1XIA_P14 (SEQ ID NO:1372), comprising a polypeptide being at least 70%, optionally at least about 80%, preferably at least about 85%, more preferably at least about 90% and most preferably at least about 95% homologous to the sequence VSMMIINSQTIMVVNYSSSFITLML (SEQ ID NO: 256) in HUMCA1XIA_P14 (SEQ ID NO:1372).

According to preferred embodiments of the present invention, there is provided an isolated chimeric polypeptide encoding for HUMCA1XIA_P15 (SEQ ID NO:1373), comprising a first amino acid sequence being at least 90% homologous to MEPWSSRWKTKRWLWDFTVTTLALT-FLFQAREVRGAAPVDVLKALDF-HNSPEGISKTTGFCTNRKNSKG SDTAYRVSKQAQL-SAPTKQLFPGGTFPEDFSILFTVKPKKGIQSFLLSIYN-EHGIQQIGVEVGRSPVFLFEDH TGKPAPEDY-PLFRTVNIADGKWHRVAISVEKKTVT-MIVDCKKKTTKPLDRSERAIVDTNGITVFGTRILDE EVFEGDIQQFLITGDPKAAYDYCEHYSP-DCDSSAPKAAQAQEPQIDEYAPEDIIEY-DYEYGEAEYKEAESVT EGPTVTEETIAQTEANIVD-DFQEYNYGTMESYQTEAPRHVSGTNEPNPVEEIFTE-EYLTGEDYDSQRKNSE DTLYENKEIDGRDS-DLLVDGDLGEYDFYEYKEYEDKPTSPP-NEEFGPGVPAETDITETSINGHGAYGEKGQ KGEPAVVEPGMLVEGPPGPAGPAGIMGP-PGLQGPTGPPGDPGDRGPPGRPGLPGAD-GLPGPPGTMLMLPF RYGGDGSKGPTI-SAQEAQAQAILQQARIALRGPPGPMGLTGRPGPVGG-PGSSGAKGESGDPGPQGPRGVQ GPPGPTGK-PGKRGRPGADGGRGMPGEPGAKGDRG-FDGLPGLPGDKGHRGERGPQGPPGPPGDDGMRGE DGEIGPRGLPGEAGPRGLLGPRGTP-GAPGQPGMAGVDGPPGPKGNMGPQGEPG-PPGQQGNPGPQGLPGPQ GPIGPPGEK corresponding to amino acids 1-714 of CA1B_HUMAN (SEQ ID NO:1446), which also corresponds to amino acids 1-714 of HUMCA1XIA_P15 (SEQ ID NO:1373), and a second amino acid sequence being at least 70%, optionally at least 80%, preferably at least 85%, more preferably at least 90% and most preferably at least 95% homologous to a polypeptide having the sequence MCCNLSFGILIPLQK (SEQ ID NO: 257) corresponding to amino acids 715-729 of HUMCA1XIA_P15 (SEQ ID NO:1373), wherein said first amino acid sequence and second amino acid sequence are contiguous and in a sequential order.

According to preferred embodiments of the present invention, there is provided an isolated polypeptide encoding for a tail of HUMCA1XIA_P15 (SEQ ID NO:1373), comprising a polypeptide being at least 70%, optionally at least about 80%, preferably at least about 85%, more preferably at least about 90% and most preferably at least about 95% homologous to the sequence MCCNLSFGILIPLQK (SEQ ID NO: 257) in HUMCA1XIA_P15 (SEQ ID NO:1373).

According to preferred embodiments of the present invention, there is provided an isolated chimeric polypeptide encoding for HUMCA1XIA_P16 (SEQ ID NO:1374), comprising a first amino acid sequence being at least 90% homologous to MEPWSSRWKTKRWLWDFTVTTLALT-FLFQAREVRGAAPVDVLKALDF-HNSPEGISKTTGFCTNRKNSKG SDTAYRVSKQAQL-SAPTKQLFPGGTFPEDFSILFTVKPKKGIQSFLLSIYN-EHGIQQIGVEVGRSPVFLFEDH TGKPAPEDY-PLFRTVNIADGKWHRVAISVEKKTVT-MIVDCKKKTTKPLDRSERAIVDTNGITVFGTRILDE EVFEGDIQQFLITGDPKAAYDYCEHYSP-DCDSSAPKAAQAQEPQIDEYAPEDIIEY-DYEYGEAEYKEAESVT EGPTVTEETIAQTEANIVD-DFQEYNYGTMESYQTEAPRHVSGTNEPNPVEEIFTE-EYLTGEDYDSQRKNSE DTLYENKEIDGRDS-DLLVDGDLGEYDFYEYKEYEDKPTSPP-NEEFGPGVPAETDITETSINGHGAYGEKGQ KGEPAVVEPGMLVEGPPGPAGPAGIMGP-PGLQGPTGPPGDPGDRGPPGRPGLPGAD-GLPGPPGTMLMLPF RYGGDGSKGPTI-SAQEAQAQAILQQARIALRGPPGPMGLTGRPGPVGG-PGSSGAKGESGDPGPQGPRGVQ GPPGPTGK-PGKRGRPGADGGRGMPGEPGAKGDRG-FDGLPGLPGDKGHRGERGPQGPPGPPGDDGMRGE DGEIGPRGLPGEA corresponding to amino acids 1-648 of CA1B_HUMAN (SEQ ID NO:1446), which also corresponds to amino acids 1-648 of HUMCA1XIA_P16 (SEQ ID NO:1374), a second amino acid sequence being at least 90% homologous to GMAGVDGPPGPKGNMGPQGEPGP-PGQQGNPGPQGLPGPQGPIGPPGEK corresponding to amino acids 667-714 of CA1B_HUMAN (SEQ ID NO:1446), which also corresponds to amino acids 649-696 of HUMCA1XIA_P16 (SEQ ID NO:1374), and a third amino acid sequence being at least 70%, optionally at least 80%, preferably at least 85%, more preferably at least 90% and most preferably at least 95% homologous to a polypeptide having the sequence VSFSFSLFYKKVIKFACD-KRFVGRHDERKVVKLSLPLYLIYE (SEQ ID NO: 258) corresponding to amino acids 697-738 of HUMCA1XIA_P16 (SEQ ID NO:1374), wherein said first amino acid sequence, second amino acid sequence and third amino acid sequence are contiguous and in a sequential order.

According to preferred embodiments of the present invention, there is provided an isolated chimeric polypeptide encoding for an edge portion of HUMCA1XIA_P16 (SEQ ID NO:1374), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648-x to 648; and ending at any of amino acid numbers 649+((n−2)−x), in which x varies from 0 to n−2.

According to preferred embodiments of the present invention, there is provided an isolated polypeptide encoding for a tail of HUMCA1XIA_P16 (SEQ ID NO:1374), comprising a polypeptide being at least 70%, optionally at least about 80%, preferably at least about 85%, more preferably at least about 90% and most preferably at least about 95% homologous to the sequence VSFSFSLFYKKVIKFACD-KRFVGRHDERKVVKLSLPLYLIYE (SEQ ID NO: 258) in HUMCA1XIA_P16 (SEQ ID NO:1374).

According to preferred embodiments of the present invention, there is provided an isolated chimeric polypeptide encoding for HUMCA1XIA_P17 (SEQ ID NO:1375), comprising a first amino acid sequence being at least 90% homologous to MEPWSSRWKTKRWLWDFTVTTLALT-FLFQAREVRGAAPVDVLKALDF-HNSPEGISKTTGFCTNRKNSKG SDTAYRVSKQAQL-SAPTKQLFPGGTFPEDFSILFTVKPKKGIQSFLLSIYN-EHGIQQIGVEVGRSPVFLFEDH TGKPAPEDY-PLFRTVNIADGKWHRVAISVEKKTVTMIVDCKK-KTTKPLDRSERAIVDTNGITVFGTRILDE EVFEGDIQQFLITGDPKAAYDYCEHYSPDCDSSA-PKAAQAQEPQIDE corresponding to amino acids 1-260 of CA1B_HUMAN (SEQ ID NO:1446), which also corresponds to amino acids 1-260 of HUMCA1XIA_P17 (SEQ ID NO:1375), and a second amino acid sequence being at least 70%, optionally at least 80%, preferably at least 85%, more preferably at least 90% and most preferably at least 95% homologous to a polypeptide having the sequence VRSTR-PEKVFVFQ (SEQ ID NO: 259) corresponding to amino acids 261-273 of HUMCA1XIA_P17 (SEQ ID NO:1375), wherein said first amino acid sequence and second amino acid sequence are contiguous and in a sequential order.

According to preferred embodiments of the present invention, there is provided an isolated polypeptide encoding for a tail of HUMCA1XIA_P17 (SEQ ID NO:1375), comprising a polypeptide being at least 70%, optionally at least about 80%, preferably at least about 85%, more preferably at least about 90% and most preferably at least about 95% homologous to the sequence VRSTRPEKVFVFQ in HUMCA1XIA_P17 (SEQ ID NO:1375).

According to preferred embodiments of the present invention, there is provided an isolated chimeric polypeptide encoding for R20779_P2 (SEQ ID NO:1402), comprising a first amino acid sequence being at least 90% homologous to MCAERLGQFMTLALVLATFDPARGTDAT-NPPEGPQDRSSQQKGRLSLQNTAEIQH-CLVNAGDVGCGVFE CFENNSCEIRGLHGICMTFLH-NAGKFDAQGKSFIKDALKCKAHALRHRFGCISRKCP-AIREMVSQLQRECY LKHDLCAAAQENTRVIVEMIH-FKDLLLHE corresponding to amino acids 1-169 of STC2_HUMAN (SEQ ID NO:1458), which also corresponds to amino acids 1-169 of R20779_P2 (SEQ ID NO:1402), and a second amino acid sequence being at least 70%, optionally at least 80%, preferably at least 85%, more preferably at least 90% and most preferably at least 95% homologous to a polypeptide having the sequence CYKIEITMP-KRRKVKLRD (SEQ ID NO: 260) corresponding to amino acids 170-187 of R20779_P2 (SEQ ID NO:1402), wherein said first amino acid sequence and second amino acid sequence are contiguous and in a sequential order.

According to preferred embodiments of the present invention, there is provided an isolated polypeptide encoding for a tail of R20779_P2 (SEQ ID NO:1402), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO: 260) in R20779_P2 (SEQ ID NO:1402).

According to preferred embodiments of the present invention, there is provided an isolated chimeric polypeptide encoding for HUMOSTRO_PEA_1_PEA_1_P21 (SEQ ID NO:1627), comprising a first amino acid sequence being at least 90% homologous to MRIAVICFCLLGITCAIPVKQA-DSGSSEEKQLYNKYPDAVATWLNPDPSQKQNLLAPQ corresponding to amino acids 1-58 of OSTP_HUMAN (SEQ ID NO:1462), which also corresponds to amino acids 1-58 of HUMOSTRO_PEA_1_PEA_1_P21 (SEQ ID NO:1627), and a second amino acid sequence being at least 70%, optionally at least 80%, preferably at least 85%, more preferably at least 90% and most preferably at least 95% homologous to a polypeptide having the sequence VFLNFS (SEQ ID NO: 261) corresponding to amino acids 59-64 of HUMOSTRO_PEA_1_PEA_1_P21 (SEQ ID NO:1627), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P21 (SEQ ID NO:1627), comprising a polypeptide being at least 70%, optionally at least about 80%, preferably at least about 85%, more preferably at least about 90% and most preferably at least about 95% homologous to the sequence VFLNFS (SEQ ID NO: 261) in HUMOSTRO_PEA_1_PEA_1_P21 (SEQ ID NO:1627).

According to preferred embodiments of the present invention, there is provided an isolated chimeric polypeptide encoding for HUMOSTRO_PEA_1_PEA_1_P25 (SEQ ID NO:1628), comprising a first amino acid sequence being at least 90% homologous to MRIAVICF-CLLGITCAIPVKQADSGSSEEKQ corresponding to amino acids 1-31 of OSTP_HUMAN (SEQ ID NO:1462), which also corresponds to amino acids 1-31 of HUMOSTRO_PEA_1_PEA_1_P25 (SEQ ID NO:1628), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO:1628), wherein said first amino acid sequence and second amino acid sequence are contiguous and in a sequential order.

According to preferred embodiments of the present invention, there is provided an isolated chimeric polypeptide encoding for HUMOSTRO_PEA_1_PEA_1_P30 (SEQ ID NO:1629), comprising a first amino acid sequence being at least 90% homologous to MRIAVICF-CLLGITCAIPVKQADSGSSEEKQ corresponding to amino acids 1-31 of OSTP_HUMAN (SEQ ID NO:1462), which also corresponds to amino acids 1-31 of HUMOSTRO_PEA_1_PEA_1_P30 (SEQ ID NO:1629), and a second amino acid sequence being at least 70%, optionally at least 80%, preferably at least 85%, more preferably at least 90% and most preferably at least 95% homologous to a polypeptide having the sequence VSIFYVFI (SEQ ID NO: 262) corresponding to amino acids 32-39 of HUMOSTRO_PEA_1_PEA_1_P30 (SEQ ID NO:1629), wherein said first amino acid sequence and second amino acid sequence are contiguous and in a sequential order.

According to preferred embodiments of the present invention, there is provided an isolated polypeptide encoding for a tail of HUMOSTRO_PEA_1_PEA_1_P30 (SEQ ID NO:1629), comprising a polypeptide being at least 70%, optionally at least about 80%, preferably at least about 85%, more preferably at least about 90% and most preferably at least about 95% homologous to the sequence VSIFYVFI (SEQ ID NO: 262) in HUMOSTRO_PEA_1_PEA_1_P30 (SEQ ID NO:1629).

According to preferred embodiments of the present invention, there is provided an isolated chimeric polypeptide encoding for HUMPHOSLIP_PEA_2_P10 (SEQ ID NO:1327), comprising a first amino acid sequence being at least 90% homologous to MALFGALFLALLAGAHAEF-PGCKIRVTSKALELVKQEGLRFLEQE-LETITIPDLRGKEGHFYYNISE corresponding to amino acids 1-67 of PLTP_HUMAN (SEQ ID NO:1433), which also corresponds to amino acids 1-67 of HUMPHOSLIP_PEA_2_P10 (SEQ ID NO:1327), and a second amino acid sequence being at least 90% homologous to KVYDFLST-FITSGMRFLLNQQICPVLYHAGTVLLNSLLDTVP-VRSSVDELVGIDYSLMKDPVASTSNLDMD FRGAFF-PLTERNWSLPNRAVEPQLQEEERMVYVAFSEFF-FDSAMESYFRAGALQLLLVGDKVPHDLDMLL RATY-FGSIVLLSPAVIDSPLKLELRVLAPPRCTIKPSGTTISV-TASVTIALVPPDQPEVQLSSMTMDARLSAK MAL-RGKALRTQLDLRRFRIYSNHSALESLALIPLQAPL-KTMLQIGVMPMLNERTWRGVQIPLPEGINFVHE VVTNHAGFLTIGADLHFAKGLREVIEKNRPADVRA-STAPTPSTAAV corresponding to amino acids 163-493 of PLTP_HUMAN (SEQ ID NO:1433), which also corresponds to amino acids 68-398 of HUMPHOSLIP_ PEA_2_P10 (SEQ ID NO:1327), wherein said first amino acid sequence and second amino acid sequence are contiguous and in a sequential order.

According to preferred embodiments of the present invention, there is provided an isolated chimeric polypeptide encoding for an edge portion of HUMPHOSLIP_PEA_2_P10 (SEQ ID NO:1327), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67-x to 67; and ending at any of amino acid numbers 68+((n−2)−x), in which x varies from 0 to n−2.

According to preferred embodiments of the present invention, there is provided an isolated chimeric polypeptide encoding for HUMPHOSLIP_PEA_2_P12 (SEQ ID NO:1328), comprising a first amino acid sequence being at least 90% homologous to MALFGALFLALLAGAHAEF-PGCKIRVTSKALELVKQEGLRFLEQE-LETITIPDLRGKEGHFYYNISEVKVTE LQLTSSELD-FQPQQELMLQITNASLGLRFRRQLLYWFFYDGGYIN-ASAEGVSIRTGLELSRDPAGRMKVSN VSCQASVS-RMHAAFGGTFKKVYDFLSTFITSGMR-FLLNQQICPVLYHAGTVLLNSLLDTVPVRSSVDELVG IDYSLMKDPVASTSNLDMDFRGAFF-PLTERNWSLPNPAVEPQLQEEERMVY-VAFSEFFFDSAMESYFRAG ALQLLLVGDKVPHDLD-MLLRATYFGSIVLLSPAVIDSPLKLELRVLAPPRCTIK-PSGTTISVTASVTIALVPP DQPEVQLSSMTMDARL-SAKMALRGKALRTQLDLRRFRIYSNH-SALESLALIPLQAPLKTMLQIGVMPMLN corresponding to amino acids 1-427 of PLTP_HUMAN (SEQ ID NO:1433), which also corresponds to amino acids 1-427 of HUMPH-OSLIP_PEA_2_P12 (SEQ ID NO:1328), and a second amino acid sequence being at least 70%, optionally at least 80%, preferably at least 85%, more preferably at least 90% and most preferably at least 95% homologous to a polypeptide having the sequence GKAGV (SEQ ID NO: 263) corresponding to amino acids 428-432 of HUMPHOSLIP_PEA_2_P12 (SEQ ID NO:1328), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P12 (SEQ ID NO:1328), comprising a polypeptide being at least 70%, optionally at least about 80%, preferably at least about 85%, more preferably at least about 90% and most preferably at least about 95% homologous to the sequence GKAGV (SEQ ID NO: 263) in HUMPHOSLIP_PEA_2_P12 (SEQ ID NO:1328).

According to preferred embodiments of the present invention, there is provided an isolated chimeric polypeptide encoding for HUMPHOSLIP_PEA_2_P31 (SEQ ID NO:1330), comprising a first amino acid sequence being at least 90% homologous to MALFGALFLALLAGAHAEF-PGCKIRVTSKALELVKQEGLRFLEQE-LETITIPDLRGKEGHFYYNISE corresponding to amino acids 1-67 of PLTP_HUMAN (SEQ ID NO:1433), which also corresponds to amino acids 1-67 of HUMPHOSLIP_PEA_2_P31 (SEQ ID NO:1330), and a second amino acid sequence being at least 70%, optionally at least 80%, preferably at least 85%, more preferably at least 90% and most preferably at least 95% homologous to a polypeptide having the sequence PGLERGADKFPVVGGSSLFLALDLTLRP-PVG (SEQ ID NO: 264) corresponding to amino acids 68-98 of HUMPHOSLIP_PEA_2_P31 (SEQ ID NO:1330), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P31 (SEQ ID NO:1330), comprising a polypeptide being at least 70%, optionally at least about 80%, preferably at least about 85%, more preferably at least about 90% and most preferably at least about 95% homologous to the sequence PGLERGADKFPV-VGGSSLFLALDLTLRPPVG (SEQ ID NO: 264) in HUMPHOSLIP_PEA_2_P31 (SEQ ID NO:1330).

According to preferred embodiments of the present invention, there is provided an isolated chimeric polypeptide encoding for HUMPHOSLIP_PEA_2_P33 (SEQ ID NO:1331), comprising a first amino acid sequence being at least 90% homologous to MALFGALFLALLAGAHAEF-PGCKIRVTSKALELVKQEGLRFLEQE-LETITIPDLRGKEGHFYYNISEVKVTE LQLTSSELD-FQPQQELMLQITNASLGLRFRRQLLYWFFYDGGYIN-ASAEGVSIRTGLELSRDPAGRMKVSN VSCQASVS-RMHAAFGGTFKKVYDFLSTFITSGMRFLLNQQ corresponding to amino acids 1-183 of PLTP_HUMAN (SEQ ID NO:1433), which also corresponds to amino acids 1-183 of HUMPHOSLIP_PEA_2_P33 (SEQ ID NO:1331), and a second amino acid sequence being at least 70%, optionally at least 80%, preferably at least 85%, more preferably at least 90% and most preferably at least 95% homologous to a polypeptide having the sequence VWAATGRRVARVG-MLSL (SEQ ID NO: 265) corresponding to amino acids 184-200 of HUMPHOSLIP_PEA_2_P33 (SEQ ID NO:1331), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P33 (SEQ ID NO:1331), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 265) in HUMPHOSLIP_PEA_2_P33 (SEQ ID NO:1331).

According to preferred embodiments of the present invention, there is provided an isolated chimeric polypeptide encoding for HUMPHOSLIP_PEA_2_P34 (SEQ ID NO:1332), comprising a first amino acid sequence being at least 90% homologous to MALFGALFLALLAGAHAEF-PGCKIRVTSKALELVKQEGLRFLEQE-LETITIPDLRGKEGHFYYNISEVKVTE LQLTSSELD-FQPQQELMLQITNASLGLRFRRQLLYWFFYDGGYIN-ASAEGVSIRTGLELSRDPAGRMKVSN VSCQASVS-RMHAAFGGTFKKVYDFLSTFITSGMR-FLLNQQICPVLYHAGTVLLNSLLDTVPV corresponding to amino acids 1-205 of PLTP_HUMAN (SEQ ID NO:1433), which also corresponds to amino acids 1-205 of HUMPH-OSLIP_PEA_2_P34 (SEQ ID NO:1332), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 266) corresponding to amino acids 206-217 of HUMPH-OSLIP_PEA_2_P34 (SEQ ID NO:1332), wherein said first amino acid sequence and second amino acid sequence are contiguous and in a sequential order.

According to preferred embodiments of the present invention, there is provided an isolated polypeptide encoding for a tail of HUMPHOSLIP_PEA_2_P34 (SEQ ID NO:1332), comprising a polypeptide being at least 70%, optionally at least about 80%, preferably at least about 85%, more preferably at least about 90% and most preferably at least about 95% homologous to the sequence LWTSLLALTIPS (SEQ ID NO: 266) in HUMPHOSLIP_PEA_2_P34 (SEQ ID NO:1332).

According to preferred embodiments of the present invention, there is provided an isolated chimeric polypeptide encoding for HUMPHOSLIP_PEA_2_P35 (SEQ ID NO:1333), comprising a first amino acid sequence being at least 90% homologous to MALFGALFLALLAGAHAEF-PGCKIRVTSKALELVKQEGLRFLEQE-LETITIPDLRGKEGHFYYNISEVKVTE LQLTSSELD-FQPQQELMLQITNASLGLRFRRQLLYWF corresponding to amino acids 1109 of PLTP_HUMAN (SEQ ID NO:1433), which also corresponds to amino acids 1-109 of HUMPHOSLIP_PEA_2_P35 (SEQ ID NO:1333), a second amino acid sequence bridging amino acid sequence comprising of L, a third amino acid sequence being at least 90% homologous to KVYDFLSTFITSGMRFLLNQQ corresponding to amino acids 163-183 of PLTP_HUMAN (SEQ ID NO:1433), which also corresponds to amino acids 111-131 of HUMPHOSLIP_PEA_2_P35 (SEQ ID NO:1333), and a fourth amino acid sequence being at least 70%, optionally at least 80%, preferably at least 85%, more preferably at least 90% and most preferably at least 95% homologous to a polypeptide having the sequence VWAATGRRVARVG-MLSL (SEQ ID NO: 265) corresponding to amino acids 132-148 of HUMPHOSLIP_PEA_2_P35 (SEQ ID NO:1333), wherein said first amino acid sequence, second amino acid sequence, third amino acid sequence and fourth amino acid sequence are contiguous and in a sequential order.

According to preferred embodiments of the present invention, there is provided an isolated polypeptide encoding for an edge portion of HUMPHOSLIP_PEA_2_P35 (SEQ ID NO:1333), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA_2_P35 (SEQ ID NO:1333)): a sequence starting from any of amino acid numbers 109-x to 109; and ending at any of amino acid numbers 111+((n−2)−x), in which x varies from 0 to n−2.

According to preferred embodiments of the present invention, there is provided an isolated polypeptide encoding for a tail of HUMPHOSLIP_PEA_2_P35 (SEQ ID NO:1333), comprising a polypeptide being at least 70%, optionally at least about 80%, preferably at least about 85%, more preferably at least about 90% and most preferably at least about 95% homologous to the sequence VWAATGRRVARVG-MLSL (SEQ ID NO: 265) in HUMPHOSLIP_PEA_2_P35 (SEQ ID NO:1333).

According to preferred embodiments of the present invention, there is provided an isolated chimeric polypeptide encoding for R38144_PEA_2_P6 (SEQ ID NO:1403), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIRVVGGL-LSAHLLSKKAGVEVE AGWPCSGPLLRMAEE-AARKLLPAFQTPTGMPYGTVNLLHGVN-PGETPVTCTAGIGTFIVEFATLSSLTGDP VFED-VARVALMRLWESRSDIGLVGNHIDVLTGKWVAQDA-GIGAGVDSYFEYLVKGAILLQDKKLMAMF LEYN-KAIRNYTRFDDWYLWVQMYKGTVSMPVFQSLEAY-WPGLQSLIGDIDNAMRTFLNYYTVWKQFGG LPE-FYNIPQGYTVEKREGYPLRPELIESAMYLYRATGD-PTLLELGRDAVESIEKISKVECGFAT corresponding to amino acids 1-412 of CT31_HUMAN (SEQ ID NO:1459), which also corresponds to amino acids 1-412 of R38144_PEA_2_P6 (SEQ ID NO:1403), and a second amino acid sequence being at least 70%, optionally at least 80%, preferably at least 85%, more preferably at least 90% and most preferably at least 95% homologous to a polypeptide having the sequence LASFSHMSDQRSARPQAGQPH-GVVLPGRDCEIPLPPV (SEQ ID NO: 268) corresponding to amino acids 413-449 of R38144_PEA_2_P6 (SEQ ID NO:1403), wherein said first amino acid sequence and second amino acid sequence are contiguous and in a sequential order.

According to preferred embodiments of the present invention, there is provided an isolated polypeptide encoding for a tail of R38144_PEA_2_P6 (SEQ ID NO:1403), comprising a polypeptide being at least 70%, optionally at least about 80%, preferably at least about 85%, more preferably at least about 90% and most preferably at least about 95% homologous to the sequence LASFSHMSDQRSARPQAGQPHGV-VLPGRDCEIPLPPV (SEQ ID NO: 268) in R38144_PEA_2_P6 (SEQ ID NO:1403).

According to preferred embodiments of the present invention, there is provided an isolated chimeric polypeptide encoding for R38144_PEA_2_P13 (SEQ ID NO:1404), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIRVVGGL- LSAHLLSKKAGVEVE AGWPCSGPLLRMAEE-AARKLLPAFQTPTGMPYGTVNLLHGVNPGETPVTCT-AGIGTFIVEFATLSSLTGDP VFEDVARVALMRL-WESRSDIGLVGNHIDVLTGKWVAQDAGIGAGVDSYF-EYLVKGAILLQDKKLMAMF LEYNKAIRNYTRFD-DWYLWVQMYKGTVSMPVFQSLEAYWPGLQ corresponding to amino acids 1-323 of CT31_HUMAN (SEQ ID NO:1459), which also corresponds to amino acids 1-323 of R38144_PEA_2_P13 (SEQ ID NO:1404), and a second amino acid sequence being at least 70%, optionally at least 80%, preferably at least 85%, more preferably at least 90% and most preferably at least 95% homologous to a polypeptide having the sequence NLLKAQCTSTVPRGIPPS (SEQ ID NO: 269) corresponding to amino acids 324-341 of R38144_PEA_2_P13 (SEQ ID NO:1404), wherein said first amino acid sequence and second amino acid sequence are contiguous and in a sequential order.

According to preferred embodiments of the present invention, there is provided an isolated polypeptide encoding for a tail of R38144_PEA_2_P13 (SEQ ID NO:1404), comprising a polypeptide being at least 70%, optionally at least about 80%, preferably at least about 85%, more preferably at least about 90% and most preferably at least about 95% homologous to the sequence NLLKAQCTSTVPRGIPPS (SEQ ID NO: 269) in R38144_PEA_2_P13 (SEQ ID NO:1404).

According to preferred embodiments of the present invention, there is provided an isolated chimeric polypeptide encoding for R38144_PEA_2_P15 (SEQ ID NO:1405), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIRVVGGL-LSAHLLSKKAGVEVE AGWPCSGPLLRMAEE-AARKLLPAFQTPTGMPYGTVNLLHGVN-PGETPVTCTAGIGTFIVEFATLSSLTGDP VFED-VARVALMRLWESRSDIGLVGNHIDVLTGKWVAQDAG-IGAGVDSYFEYLVKGAILLQDKKLMAMF LE corresponding to amino acids 1-282 of CT31_HUMAN (SEQ ID NO:1459), which also corresponds to amino acids 1-282 of R38144_PEA_2_P15 (SEQ ID NO:1405), and a second amino acid sequence being at least 70%, optionally at least 80%, preferably at least 85%, more preferably at least 90% and most preferably at least 95% homologous to a polypeptide having the sequence PHWRH (SEQ ID NO: 270) corresponding to amino acids 283-287 of R38144_PEA_2_P15 (SEQ ID NO:1405), wherein said first amino acid sequence and second amino acid sequence are contiguous and in a sequential order.

According to preferred embodiments of the present invention, there is provided an isolated polypeptide encoding for a tail of R38144_PEA_2_P15 (SEQ ID NO:1405), comprising a polypeptide being at least 70%, optionally at least about 80%, preferably at least about 85%, more preferably at least about 90% and most preferably at least about 95% homologous to the sequence PHWRH (SEQ ID NO: 270) in R38144_PEA_2_P15 (SEQ ID NO:1405).

According to preferred embodiments of the present invention, there is provided an isolated chimeric polypeptide encoding for R38144_PEA_2_P19 (SEQ ID NO:1406), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIRVVGGL-LSAHLLSKKAGVEVE AGWPCSGPLLRMAEE-AARKLLPAFQTPTGMPYGTVNLLHGVN-PGETPVTCTAGIGTFIVEFATLSSLTGDP VFED-VARVALMRLWESRSDIGLVGNHIDVLTGKWVAQDA-GIGAGVDSYFEYLVKGAILLQDKKLMAMF LEYN-KAIRNYTRFDDWYLWVQMYKGTVSMPVFQSL-EAYWPGLQSLIGDIDNAMRTFLNYYTVWKQFGG LPEFYNIPQGYTVEKREGYPLRPELIE-SAMYLRATGDPTLLELGRDAVESIEKISKVECGFAT corresponding to amino acids 1-412 of CT31_HUMAN (SEQ ID NO:1459), which also corresponds to amino acids 1-412 of R38144_PEA_2_P19 (SEQ ID NO:1406), and a second amino acid sequence being at least 70%, optionally at least 80%, preferably at least 85%, more preferably at least 90% and most preferably at least 95% homologous to a polypeptide having the sequence KRSRSVA-QAGVQWCDHDSPQP (SEQ ID NO: 270) corresponding to amino acids 413-433 of R38144_PEA_2_P19 (SEQ ID NO:1406), wherein said first amino acid sequence and second amino acid sequence are contiguous and in a sequential order.

According to preferred embodiments of the present invention, there is provided an isolated polypeptide encoding for a tail of R38144_PEA_2_P19 (SEQ ID NO:1406), comprising a polypeptide being at least 70%, optionally at least about 80%, preferably at least about 85%, more preferably at least about 90% and most preferably at least about 95% homologous to the sequence KRSRSVAQAGVQWCDHDSPQP (SEQ ID NO: 270) in R38144_PEA_2_P19 (SEQ ID NO:1406).

According to preferred embodiments of the present invention, there is provided an isolated chimeric polypeptide encoding for R38144_PEA_2_P24 (SEQ ID NO:1407), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIR corresponding to amino acids 1-121 of CT31_HUMAN (SEQ ID NO:1459), which also corresponds to amino acids 1-121 of R38144_PEA_2_P24 (SEQ ID NO:1407), and a second amino acid sequence being at least 90% homologous to EYNKAIRNYTRFDDWYLWVQMYKGTVSMPVF-QSLEAYWPGLQSLIGDIDNAMRTFLNYYT-VWKQFGGL PEFYNIPQGYTVEKREGYPLRPELIESA-MYLYRATGDPTLLELGRDAV-ESIEKISKVECGFATIKDLRDHKL DNRMESFFLA-ETVKYLYLLFDPTNFIHNNGSTFDAVITPYGECILGA-GGYIFNTEAHPIDPAALHCCQRLKE EQWEVEDLM-REFYSLKRSRSKFQKNTVSSGPWEPPAR-PGTLFSPENHDQARERKPAKQKVPLLSCPSQPFT SKLALLGQVFLDSS corresponding to amino acids 282-578 of CT31_HUMAN (SEQ ID NO:1459), which also corresponds to amino acids 122-418 of R38144_PEA_2_P24 (SEQ ID NO:1407), wherein said first amino acid sequence and second amino acid sequence are contiguous and in a sequential order.

According to preferred embodiments of the present invention, there is provided an isolated chimeric polypeptide encoding for an edge portion of R38144PEA_2_P24 (SEQ ID NO:1407), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RE, having a structure as follows: a sequence starting from any of amino acid numbers 121-x to 121; and ending at any of amino acid numbers 122+((n−2)−x), in which x varies from 0 to n−2.

According to preferred embodiments of the present invention, there is provided an isolated chimeric polypeptide encoding for R38144_PEA_2 P36 (SEQ ID NO:1408), comprising a first amino acid sequence being at least 90% homologous to MPFRLLIPLGLLCALLPQHHGAPGPDG-SAPDPAHYR corresponding to amino acids 1-36 of AAH16184 (SEQ ID NO:1460), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGM-SQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWT-LILM (SEQ ID NO: 272) in R38144_PEA_2_P36 (SEQ ID NO:1408).

According to preferred embodiments of the present invention, there is provided an isolated chimeric polypeptide encoding for R38144_PEA_2_P36 (SEQ ID NO:1408), comprising a first amino acid sequence being at least 90% homologous to MPFRLLIPLGLLCALLPQHHGAPGPDG-SAPDPAHY corresponding to amino acids 1-35 of AAQ88943 (SEQ ID NO:1461), which also corresponds to amino acids 1-35 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence RFWGM-SQNSKEWLKCSRTAWTLILM corresponding to amino acids 36-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence RFWGMSQNSKEWLKCSRTAWT-LILM in R38144_PEA_2_P36 (SEQ ID NO:1408).

According to preferred embodiments of the present invention, there is provided an isolated chimeric polypeptide encoding for R38144_PEA_2_P36 (SEQ ID NO:1408), comprising a first amino acid sequence being at least 90% homologous to MPFRLLIPLGLLCALLPQHHGAPGPDG-SAPDPAHYR corresponding to amino acids 1-36 of CT31_HUMAN (SEQ ID NO:1459), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGM-SQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

According to preferred embodiments of the present invention, there is provided an isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWT-LILM (SEQ ID NO: 272) in R38144_PEA_2_P36 (SEQ ID NO:1408).

According to preferred embodiments of the present invention, there is provided an isolated chimeric polypeptide encoding for AA161187_P6 (SEQ ID NO:1319), comprising a first amino acid sequence being at least 70%, optionally at least 80%, preferably at least 85%, more preferably at least 90% and most preferably at least 95% homologous to a polypeptide having the sequence HTREGTLGGQKRAFP-DGVEGEKGRGRAWGAASRGSAVPLTIR (SEQ ID NO: 273) corresponding to amino acids 1-42 of AA161187_P6 (SEQ ID NO:1319), and a second amino acid sequence being at least 90% homologous to GPCGRRVITSRIVGGEDAEL-GRWPWQGSLRLWDSHVCGVSLLSHRWALTAAHC-FETYSDLSDPSGWMVQ FGQLTSMPSFWS-LQAYYTRYFVSNIYLSPRYLGNSPYDIALVKLSAPVT-YTKHIQPICLQASTFEFENRTDC WVTGWGYIKEDE-ALPSPHTLQEVQVAIINNSMCNHLFLKYSFRK-DIFGDMVCAGNAQGGKDACFGDSGG PLACNKNGL-WYQIGVVSWGVGCGRPNRPGVYTNISHH-FEWIQKLMAQSGMSQPDPSWPLLFFPLLWALP LLGPV corresponding to amino acids 31-314 of TEST_HU-MAN (SEQ ID NO:1431), which also corresponds to amino acids 43-326 of AA161187_P6 (SEQ ID NO:1319), wherein said first amino acid sequence and second amino acid sequence are contiguous and in a sequential order.

According to preferred embodiments of the present invention, there is provided an isolated polypeptide encoding for a head of AA161187_P6 (SEQ ID NO:1319), comprising a polypeptide being at least 70%, optionally at least about 80%, preferably at least about 85%, more preferably at least about 90% and most preferably at least about 95% homologous to the sequence HTREGTLGGQKRAFPDGVEGEKGR-GRAWGAASRGSAVPLTIR (SEQ ID NO: 273) of AA161187_P6 (SEQ ID NO:1319).

According to preferred embodiments of the present invention, there is provided an isolated chimeric polypeptide encoding for AA161187_P13 (SEQ ID NO:1320), comprising a first amino acid sequence being at least 90% homologous to MGARGALLLALLLARAGLRKPESQEAA-PLSGPCGRRVITSRIVGGEDAELGRWPWQGSLRLWD-SHVCGV SLLSHRWALTAAHCFETYSDLSDPSGWM-VQFGQLTSMPSFWSLQAYYTRYFVS-
NIYLSPRYLGNSPYDIA LVKLSAPVTYTKHIQPI-CLQASTFEFENRTDCWVTGWGYIKEDE corresponding to amino acids 1-183 of TEST_HUMAN (SEQ ID NO:1431), which also corresponds to amino acids 1-183 of AA161187_P13 (SEQ ID NO:1320), and a second amino acid sequence being at least 70%, optionally at least 80%, preferably at least 85%, more preferably at least 90% and most preferably at least 95% homologous to a polypeptide having the sequence GSSGRHHKQLYVQPPLPQVQF-PQGHLWRHG (SEQ ID NO: 274) corresponding to amino acids 184-213 of AA161187_P13 (SEQ ID NO:1320), wherein said first amino acid sequence and second amino acid sequence are contiguous and in a sequential order.

According to preferred embodiments of the present invention, there is provided an isolated polypeptide encoding for a tail of AA161187_P13 (SEQ ID NO:1320), comprising a polypeptide being at least 70%, optionally at least about 80%, preferably at least about 85%, more preferably at least about 90% and most preferably at least about 95% homologous to the sequence GSSGRHHKQLYVQPPLPQVQFPQGHLWRHG (SEQ ID NO: 274) in AA161187_P13 (SEQ ID NO:1320).

According to preferred embodiments of the present invention, there is provided an isolated chimeric polypeptide encoding for AA161187_P14 (SEQ ID NO:1321), comprising a first amino acid sequence being at least 90% homologous to MGARGALLLALLLARAGLRKPESQEAAPLSGPCGRRVITSRIVGGEDAELGRWPWQGSLRLWDSHVCGV SLLSHRWALTAAHCFETYSDLSDPSGWMVQFGQLTSMPSFWSLQAYYTRYFVSNIYLSPRYLGNSPYDIA LVKLSAPVTYTKHIQPICLQASTFEFENRTDCWVTGWGYIKEDE corresponding to amino acids 1-183 of TEST_HUMAN (SEQ ID NO:1431), which also corresponds to amino acids 1-183 of AA161187_P14 (SEQ ID NO:1321), and a second amino acid sequence being at least 70%, optionally at least 80%, preferably at least 85%, more preferably at least 90% and most preferably at least 95% homologous to a polypeptide having the sequence GCCLSPSHYRPHSTAISPHPPGSSGRHHKQLYVQPPLPQVQFPQGHLWRHGLCWQCPRREGCLLRECPCH HSQPRKASCVPVPYLTLMPTPGGGDCCPTLQMQKRRLGCCQGEEEDVHPVYPAP (SEQ ID NO: 275) corresponding to amino acids 184-307 of AA161187_P14 (SEQ ID NO:1321), wherein said first amino acid sequence and second amino acid sequence are contiguous and in a sequential order.

According to preferred embodiments of the present invention, there is provided an isolated polypeptide encoding for a tail of AA161187_P14 (SEQ ID NO:1321), comprising a polypeptide being at least 70%, optionally at least about 80%, preferably at least about 85%, more preferably at least about 90% and most preferably at least about 95% homologous to the sequence GCCLSPSHYRPHSTAISPHPPGSSGRHHKQLYVQPPLPQVQFPQGHLWRHGLCWQCPRREGCLLRECPCH HSQPRKASCVPVPYLTLMPTPGGGDCCPTLQMQKRRLGCCQGEEEDVHPVYPAP (SEQ ID NO: 275) in AA161187_P14 (SEQ ID NO:1321).

According to preferred embodiments of the present invention, there is provided an isolated chimeric polypeptide encoding for AA161187_P18 (SEQ ID NO:1322), comprising a first amino acid sequence being at least 70%, optionally at least 80%, preferably at least 85%, more preferably at least 90% and most preferably at least 95% homologous to a polypeptide having the sequence HTREGTLGGQKRAFPDGVEGEKGRGRAWGAASRGSAVPLTIR (SEQ ID NO: 273) corresponding to amino acids 1-42 of AA161187_P18 (SEQ ID NO:1322), a second amino acid sequence being at least 90% homologous to GPCGRRVITSRIVGGEDAELGRWPWQGSLRLWDSHVCGVSLLSHRWALTAAHCFET corresponding to amino acids 31-86 of TEST_HUMAN (SEQ ID NO:1431), which also corresponds to amino acids 43-98 of AA161187_P18 (SEQ ID NO:1322), a third amino acid sequence being at least 90% homologous to DLSDPSGWMVQFGQLTSMPSFWSLQAYYTRYFVSNIYLSPRYLGNSPYDIALVKLSAPVTYTKHIQPICLQ ASTFEFENRTDCWVTGWGYIKEDEALPSPHTLQEVQVAIINNSMCNHLFLKYSFRKDIFGDMVCAGNAQG GKDACF corresponding to amino acids 89-235 of TEST_HUMAN (SEQ ID NO:1431), which also corresponds to amino acids 99-245 of AA161187_P18 (SEQ ID NO:1322), and a fourth amino acid sequence being at least 70%, optionally at least 80%, preferably at least 85%, more preferably at least 90% and most preferably at least 95% homologous to a polypeptide having the sequence VSVPATTPSPGKHPVSLCLI (SEQ ID NO: 277) corresponding to amino acids 246-265 of AA161187_P18 (SEQ ID NO:1322), wherein said first amino acid sequence, second amino acid sequence, third amino acid sequence and fourth amino acid sequence are contiguous and in a sequential order.

According to preferred embodiments of the present invention, there is provided an isolated polypeptide encoding for a head of AA161187_P18 (SEQ ID NO:1322), comprising a polypeptide being at least 70%, optionally at least about 80%, preferably at least about 85%, more preferably at least about 90% and most preferably at least about 95% homologous to the sequence HTREGTLGGQKRAFPDGVEGEKGRGRAWGAASRGSAVPLTIR (SEQ ID NO: 273) of AA161187_P18 (SEQ ID NO:1322).

According to preferred embodiments of the present invention, there is provided an isolated chimeric polypeptide encoding for an edge portion of AA161187_P18 (SEQ ID NO:1322), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 98-x to 99; and ending at any of amino acid numbers 99+((n−2)−x), in which x varies from 0 to n−2.

According to preferred embodiments of the present invention, there is provided an isolated polypeptide encoding for a tail of AA161187_P18 (SEQ ID NO:1322), comprising a polypeptide being at least 70%, optionally at least about 80%, preferably at least about 85%, more preferably at least about 90% and most preferably at least about 95% homologous to the sequence VSVPATTPSPGKHPVSLCLI (SEQ ID NO: 277) in AA161187_P18 (SEQ ID NO:1322).

According to preferred embodiments of the present invention, there is provided an isolated chimeric polypeptide encoding for AA161187_P19 (SEQ ID NO:1323), comprising a first amino acid sequence being at least 90% homologous to MGARGALLLALLLARAGLRKPESQEAAPLSGPCGRRVITSRIVGGEDAELGRWPWQGSLRLWDSHVCGV SLLSHRWALTAAHCFETYSDLSDPSGWMVQFGQLTSMPSFWSLQAYYTRYFVSNIYLSPRYLGNSPYDIA LVKLSAPVTYTKHIQPICLQASTFEFENRTDCWVTGWGYIKEDE corresponding to amino acids 1-183 of TEST_HUMAN (SEQ ID NO:1431), which also corresponds to amino acids 1-183 of AA161187_P19 (SEQ ID NO:1323), and a second amino acid sequence being at least 70%, optionally at least 80%, preferably at least 85%, more preferably at least 90% and most preferably at least 95% homologous to a polypeptide having the sequence DKRTQ (SEQ ID NO: 278) corresponding to amino acids 184-188 of AA161187_P19 (SEQ ID NO:1323), wherein said first amino acid sequence and second amino acid sequence are contiguous and in a sequential order.

According to preferred embodiments of the present invention, there is provided an isolated polypeptide encoding for a tail of AA161187_P19 (SEQ ID NO:1323), comprising a polypeptide being at least 70%, optionally at least about 80%, preferably at least about 85%, more preferably at least about 90% and most preferably at least about 95% homologous to the sequence DKRTQ (SEQ ID NO: 278) in AA161187_P19 (SEQ ID NO:1323).

According to preferred embodiments of the present invention, there is provided an isolated chimeric polypeptide encoding for Z25299_PEA__2_P2 (SEQ ID NO:1390), comprising a first amino acid sequence being at least 90% homologous to MKSSGLFPFLVLLALGTLAPWAVEGS-GKSFKAGVCPPKKSAQCLRYKKPECQSDWQCPG-KKRCCPDTCGI KCLDPVDTPNPTRRKPGKCPV-TYGQCLMLNPPNFCEMDGQCKRDLKCC-MGMCGKSCVSPVK corresponding to amino acids 1-131 of ALK1_HUMAN (SEQ ID NO:1454), which also corresponds to amino acids 1-131 of Z25299_PEA__2_P2 (SEQ ID NO:1390), and a second amino acid sequence being at least 70%, optionally at least 80%, preferably at least 85%, more preferably at least 90% and most preferably at least 95% homologous to a polypeptide having the sequence GKQGM-RAH (SEQ ID NO: 279) corresponding to amino acids 132-139 of Z25299_PEA__2_P2 (SEQ ID NO:1390), wherein said first and second amino acid sequences are contiguous and in a sequential order.

According to preferred embodiments of the present invention, there is provided an isolated polypeptide encoding for a tail of Z25299_PEA__2_P2 (SEQ ID NO:1390), comprising a polypeptide being at least 70%, optionally at least about 80%, preferably at least about 85%, more preferably at least about 90% and most preferably at least about 95% homologous to the sequence GKQGMRAH (SEQ ID NO: 279) in Z25299_PEA__2_P2 (SEQ ID NO:1390).

According to preferred embodiments of the present invention, there is provided an isolated chimeric polypeptide encoding for Z25299_PEA__2_P3 (SEQ ID NO:1391), comprising a first amino acid sequence being at least 90% homologous to MKSSGLFPFLVLLALGTLAPWAVEGS-GKSFKAGVCPPKKSAQCLRYKKPECQSDWQCP-GKKRCCPDTCGI KCLDPVDTPNPTRRKPGKCPV-TYGQCLMLNPPNFCEMDGQCKRDLKCC-MGMCGKSCVSPVK corresponding to amino acids 1-131 of ALK1_HUMAN (SEQ ID NO:1454), which also corresponds to amino acids 1-131 of Z25299_PEA__2_P3 (SEQ ID NO:1391), and a second amino acid sequence being at least 70%, optionally at least 80%, preferably at least 85%, more preferably at least 90% and most preferably at least 95% homologous to a polypeptide having the sequence GEKRHHKQLRDQEVDPLEMRRHSAG (SEQ ID NO: 269) corresponding to amino acids 132-156 of Z25299_PEA__2_P3 (SEQ ID NO:1391), wherein said first and second amino acid sequences are contiguous and in a sequential order.

According to preferred embodiments of the present invention, there is provided an isolated polypeptide encoding for a tail of Z25299_PEA__2_P3 (SEQ ID NO:1391), comprising a polypeptide being at least 70%, optionally at least about 80%, preferably at least about 85%, more preferably at least about 90% and most preferably at least about 95% homologous to the sequence GEKRHHKQLRDQEVDPLEM-RRHSAG (SEQ ID NO: 269) in Z25299_PEA__2_P3 (SEQ ID NO:1391).

According to preferred embodiments of the present invention, there is provided an isolated chimeric polypeptide encoding for Z25299_PEA__2_P7 (SEQ ID NO:1392), comprising a first amino acid sequence being at least 90% homologous to MKSSGLFPFLVLLALGTLAPWAVEGS-GKSFKAGVCPPKKSAQCLRYKKPECQSD-WQCPGKKRCCPDTCGI KCLDPVDTPNP corresponding to amino acids 1-81 of ALK1_HUMAN (SEQ ID NO:1454), which also corresponds to amino acids 1-81 of Z25299_PEA__2_P7 (SEQ ID NO:1392), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 622) corresponding to amino acids 82-89 of Z25299_PEA__2_P7 (SEQ ID NO:1392), wherein said first and second amino acid sequences are contiguous and in a sequential order.

According to preferred embodiments of the present invention, there is provided an isolated polypeptide encoding for a tail of Z25299_PEA__2_P7 (SEQ ID NO:1392), comprising a polypeptide being at least 70%, optionally at least about 80%, preferably at least about 85%, more preferably at least about 90% and most preferably at least about 95% homologous to the sequence RGSLGSAQ (SEQ ID NO: 622) in Z25299_PEA__2_P7 (SEQ ID NO:1392).

According to preferred embodiments of the present invention, there is provided an isolated chimeric polypeptide encoding for Z25299_PEA__2_P10 (SEQ ID NO:1393), comprising a first amino acid sequence being at least 90% homologous to MKSSGLFPFLVLLALGTLAPWAVEGS-GKSFKAGVCPPKKSAQCLRYKKPECQSD-WQCPGKKRCCPDTCGI KCLDPVDTPNPT corresponding to amino acids 1-82 of ALK1_HUMAN (SEQ ID NO:1454), which also corresponds to amino acids 1-82 of Z25299_PEA__2_P10 (SEQ ID NO:1393).

According to preferred embodiments of the present invention, there is provided an isolated chimeric polypeptide encoding for R66178_P3 (SEQ ID NO:1324), comprising a first amino acid sequence being at least 90% homologous to MARMGLAGAAGRWWGLALGLTAFFLPGVHSQVV-QVNDSMYGFIGTDVVLHCSFANPLPSVKITQVTWQ KSTNGSKQNVAIYNPSMGVSVLAPYRERVEFL-RPSFTDGTIRLSRLELEDEGVYICEFAT-FPTGNRESQLNL TVMAKPTNWIEGTQAVL-RAKKGQDDKVLVATCTSANGKPPSVVSWETR-LKGEAEYQEIRNPNGTVTVIS RYRLVPSREAHQQS-LACIVNYHMDRFKESLTLNVQYEPE-VTIEGFDGNWYLQRMDVKLTCKADANPPAT EYH-WTTLNGSLPKGVEAQNRTLFFKGPINYSLAGTYICEA-TNPIGTRSGQVEVNIT corresponding to amino acids 1-334 of PVR1_HUMAN (SEQ ID NO:1432), which also corresponds to amino acids 1-334 of R66178_P3 (SEQ ID NO:1324), and a second amino acid sequence being at least 70%, optionally at least 80%, preferably at least 85%, more preferably at least 90% and most preferably at least 95% homologous to a polypeptide having the sequence GEGH-SLPISPGVLQTQNCGP (SEQ ID NO: 694) corresponding to amino acids 335-354 of R66178_P3 (SEQ ID NO:1324), wherein said first amino acid sequence and second amino sequence are contiguous and in a sequential order.

According to preferred embodiments of the present invention, there is provided an isolated polypeptide encoding for a tail of R66178_P3 (SEQ ID NO:1324), comprising a polypeptide being at least 70%, optionally at least about 80%, preferably at least about 85%, more preferably at least about 90% and most preferably at least about 95% homologous to the sequence GEGHSLPISPGVLQTQNCGP (SEQ ID NO: 694) in R66178_P3 (SEQ ID NO:1324).

According to preferred embodiments of the present invention, there is provided an isolated chimeric polypeptide encoding for R66178_P4 (SEQ ID NO:1325), comprising a first amino acid sequence being at least 90% homologous to MARMGLAGAAGRWWGLALGLTAFFLPGVHSQV-VQVNDSMYGFIGTDVVLHCSFANPLPSVKITQVTWQ KSTNGSKQNVAIYNPSMGVSVLAPYRERVEFLRP-SFTDGTIRLSRLELEDEGVYICEFATFPTGNRESQLNL TVMAKPTNWIEGTQAVLRAKKGQDDKVLVATCTSA-NGKPPSVVSWETRLKGEAEYQEIRNPNGTVTVIS RYRLVPSREAHQQSLACIVNYHMDRFKESLTLNVQ-YEPEVTIEGFDGNWYLQRMDVKLTCKADANPPAT EYHWTTLNGSLPKGVEAQNRTLFFKGPINYSLAG- TYICEATNPIGTRSGQVEVNIT corresponding to amino acids 1-334 of PVR1_HUMAN (SEQ ID NO:1432), which also corresponds to amino acids 1-334 of R66178_P4 (SEQ ID NO:1325), and a second amino acid sequence being at least 70%, optionally at least 80%, preferably at least 85%, more preferably at least 90% and most preferably at least 95% homologous to a polypeptide having the sequence AFCQLIYPGKGRTRARMF (SEQ ID NO:1702) corresponding to amino acids 335-352 of R66178_P4 (SEQ ID NO:1325), wherein said first amino acid sequence and second amino acid sequence are contiguous and in a sequential order.

According to preferred embodiments of the present invention, there is provided an isolated polypeptide encoding for a tail of R66178_P4 (SEQ ID NO:1325), comprising a polypeptide being at least 70%, optionally at least about 80%, preferably at least about 85%, more preferably at least about 90% and most preferably at least about 95% homologous to the sequence AFCQLIYPGKGRTRARMF (SEQ ID NO:1702) in R66178_P4 (SEQ ID NO:1325).

According to preferred embodiments of the present invention, there is provided an isolated chimeric polypeptide encoding for R66178_P8 (SEQ ID NO:1326), comprising a first amino acid sequence being at least 90% homologous to MARMGLAGAAGRWWGLALGLTAFFLPGVHSQVVQ-VNDSMYGFIGTDVVLHCSFANPLPSVKITQVTWQ KSTNGSKQNVAIYNPSMGVSVLAPYRERVEFLR-PSFTDGTIRLSRLELEDEGVYICEFATF-PTGNRESQLNL TVMAKPTNWIEGTQAVLRAKKGQD-DKVLVATCTSANGKPPSVVSWETRLKGEAEYQEIR-NPNGTVTVIS RYRLVPSREAHQQSLACIVNYHM-DRFKESLTLNVQYEPEVTIEGFDGNW-YLQRMDVKLTCKADANPPAT EYHWTTLNGSLP-KGVEAQNRTLFFKGPINYSLAGTYICEATNPIGTRSGQVE corresponding to amino acids 1-330 of PVR1_HUMAN (SEQ ID NO:1432), which also corresponds to amino acids 1-330 of R66178_P8 (SEQ ID NO:1326), and a second amino acid sequence being at least 70%, optionally at least 80%, preferably at least 85%, more preferably at least 90% and most preferably at least 95% homologous to a polypeptide having the sequence NSPTPRLLPNMGGAPGRCPRPSL-GAWRGASCWC (SEQ ID NO:1717) corresponding to amino acids 331-363 of R66178_P8 (SEQ ID NO:1326), wherein said first amino acid sequence and second amino acid sequence are contiguous and in a sequential order.

According to preferred embodiments of the present invention, there is provided an isolated polypeptide encoding for a tail of R66178_P8 (SEQ ID NO:1326), comprising a polypeptide being at least 70%, optionally at least about 80%, preferably at least about 85%, more preferably at least about 90% and most preferably at least about 95% homologous to the sequence NSPTPRLLPNMGGAPGRCPRPSLGAWR-GASCWC (SEQ ID NO: 1717) in R66178_P8 (SEQ ID NO:1326).

According to preferred embodiments of the present invention, there is provided an isolated chimeric polypeptide encoding for HSU33147_PEA_1_P5 (SEQ ID NO:1415), comprising a first amino acid sequence being at least 90% homologous to MKLLMVLMLAALSQHCYAGSGCPL-LENVISKTINPQVSKTEYKELLQEFIDD-NATTNAIDELKECFLNQTD ETLSNVE corresponding to amino acids 1-78 of MGBA_HUMAN (SEQ ID NO:1416), which also corresponds to amino acids 1-78 of HSU33147_PEA_1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA_1_P5 (SEQ ID NO:1415), wherein said first amino acid sequence and second amino acid sequence are contiguous and in a sequential order.

According to preferred embodiments of the present invention, there is provided an isolated chimeric polypeptide encoding for an edge portion of HSU33147_PEA_1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78-x to 78; and ending at any of amino acid numbers 79+((n−2)−x), in which x varies from 0 to n−2.

According to preferred embodiments of the present invention, there is provided an isolated chimeric polypeptide encoding for HSU33147_PEA_1_P5 (SEQ ID NO:1415), comprising a first amino acid sequence being at least 90% homologous to MKLLMVLMLAALSQHCYAGSGCPL-LENVISKTINPQVSKTEYKELLQEFIDD-NATTNAIDELKECFLNQTD ETLSNVE corresponding to amino acids 1-78 of MGBA_HUMAN (SEQ ID NO:1416), which also corresponds to amino acids 1-78 of HSU33147_PEA_1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA_1_P5 (SEQ ID NO:1415), wherein said first amino acid sequence and second amino acid sequence are contiguous and in a sequential order.

According to preferred embodiments of the present invention, there is provided an isolated chimeric polypeptide encoding for an edge portion of HSU33147 PEA_1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78-x to 78; and ending at any of amino acid numbers 79+((n−2)−x), in which x varies from 0 to n−2.

According to preferred embodiments of the present invention, there is provided an isolated chimeric polypeptide encoding for M78076_PEA_1_P3 (SEQ ID NO:1350), comprising a first amino acid sequence being at least 90% homologous to MGPASPAARGLSRRPGQPPLPLLL-PLLLLLLRAQPAIGSLAGGSPGAAEAPGSAQVAG-LCGRLTLHRDLRT GRWEPDPQRSRRCLRDPQRVLEY-CRQMYPELQIARVEQATQAIPMERWCGGSRSGSCA-HPHHQVVPFRC LPGEFVSEALLVPEGCRFLHQERM-DQCESSTRRHQEAQEACSSQGLILHGSGMLLPCGS-DRFRGVEYVCCP PPGTPDPSGTAVGDPSTRSWPPG-SRVEGAEDEEEEESFPQPVDDYFVEPPQAEEEEETV-PPPSSHTLAVVGK VTPTPRPTDGVDIYFGMPGEISE-HEGFLRAKMDLEERRMRQINEVMREWAMADNQ-SKNLPKADRQALNE HFQSILQTLEEQVSGERQRL-VETHATRVIALINDQRRAALEGFLAALQADPPQAE-RVLLALRRYLRAEQKE QRHTLRHYQHVAAVDPE-KAQQMRFQVHTHLQVIEERVNQSLGLL-DQNPHLAQELRPQIQELLHSEHLGPS ELEAPA-PGGSSEDKGGLQPPDSKD corresponding to amino acids 1-517 of APP1_HUMAN (SEQ ID NO:1439), which also corresponds to amino acids 1-517 of M78076_PEA_1_P3 (SEQ ID NO:1350), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA_1_P3 (SEQ ID NO:1350), wherein said first amino acid sequence and second amino acid sequence are contiguous and in a sequential order.

According to preferred embodiments of the present invention, there is provided an isolated chimeric polypeptide encoding for M78076_PEA_1_P4 (SEQ ID NO:1351), comprising a first amino acid sequence being at least 90% homologous to MGPASPAARGLSRRPGQPPLPLLL-PLLLLLLLPAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQGLILHGSG-MLLPCGSDRFRGVEYVCCP PPGTPDPSGTAVGDP-STRSWPPGSRVEGAEDEEEEESFPQPVDDYFVEPP-QAEEEEETVPPPSSHTLAVVGK VTPTPRPTDGVDIYF-GMPGEISEHEGFLRAKMDLEERRMRQINEVMRE-WAMADNQSKNLPKADRQALNE HFQSILQTLEEQVS-GERQRLVETHATRVIALINDQRRAALEGFLAALQA-DPPQAERVLLALRRYLRAEQKE QRHTLRHYQH-VAAVDPEKAQQMRFQVHTHLQVIEERVN-QSLGLLDQNPHLAQELRPQIQELLHSEHLGPS ELEA-PAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P4 (SEQ ID NO:1351), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:1718) corresponding to amino acids 527-541 of M78076_PEA_1_P4 (SEQ ID NO:1351), wherein said first amino acid sequence and second amino acid sequence are contiguous and in a sequential order.

According to preferred embodiments of the present invention, there is provided an isolated polypeptide encoding for a tail of M78076_PEA_1_P4 (SEQ ID NO:1351), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO:1718) in M78076_PEA_1_P4 (SEQ ID NO:1351).

According to preferred embodiments of the present invention, there is provided an isolated chimeric polypeptide encoding for M78076_PEA_1_P12 (SEQ ID NO:1352), comprising a first amino acid sequence being at least 90% homologous to MGPASPAARGLSRRPGQPPLPLLL-PLLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGG-SRSGSCAHPHHQVVPFRC LPGEFVSEALLVPEGCR-FLHQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPT-PRPTDGVDIYFGMPGEISEHEGFLRAKMDLEERR-MRQINEVMREWAMADNQSKNLPKADRQALNE HFQSILQTLEEQVSGERQRLVETHATRVIALINDQR-RAALEGFLAALQADPPQAERVLLALRRYLRAEQKE QRHTLRHYQHVAAVDPEKAQQMRFQVHTHLQVI-EERVNQSLGLLDQNPHLAQELRPQIQELLHSEHLGPS ELEAPAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P12 (SEQ ID NO:1352), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO: 1719) corresponding to amino acids 527-544 of M78076_PEA_1_P12 (SEQ ID NO:1352), wherein said first amino acid sequence and second amino acid sequence are contiguous and in a sequential order.

According to preferred embodiments of the present invention, there is provided an isolated polypeptide encoding for a tail of M78076_PEA_1_P12 (SEQ ID NO:1352), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:1719) in M78076_PEA_1_P12 (SEQ ID NO:1352).

According to preferred embodiments of the present invention, there is provided an isolated chimeric polypeptide encoding for M78076_PEA_1_P14 (SEQ ID NO:1353), comprising a first amino acid sequence being at least 90% homologous to MGPASPAARGLSRRPGQPPLPLLL-PLLLLLLLRAQPAIGSLAGGSPGAAEAPGSAQVAGL-CGRLTLHRDLRT GRWEPDPQRSRRCLRDPQRVLEY-CRQMYPELQIARVEQATQAIPMERWCGGSRS-GSCAHPHHQVVPFRC LPGEFVSEALLVPEGCRFL-HQERMDQCESSTRRHQEAQEACSSQGLILHGSG-MLLPCGSDRFRGVEYVCCP PPGTPDPSGTAVGDP-STRSWPPGSRVEGAEDEEEEESFPQPVDDYFVEPP-QAEEEEETVPPPSSHTLAVVGK VTPTPRPTDGVDIYF-GMPGEISEHEGFLRAKMDLEERRMRQINEVMR-EWAMADNQSKNLPKADRQALNE HFQSILQTLE-EQVSGERQRLVETHATRVIALINDQRRAALEGFL-AALQADPPQAERVLLALRRYLRAEQKE QRHTL-RHYQHVAAVDPEKAQQMRFQVHTHLQVIEERVN-QSLGLLDQNPHLAQELRPQIQELLHSEHLGPS ELEA-PAPGGSSEDKGGLQPPDSKDDTPMTLPKGSTEQ-DAASPEKEKMNPLEQYERKVNASVPRGFPFHSSE IQRDEL corresponding to amino acids 1-570 of APP1_HUMAN (SEQ ID NO:1439), which also corresponds to amino acids 1-570 of M78076_PEA_1_P14 (SEQ ID NO:1353), and a second amino acid sequence being at least 70%, optionally at least 80%, preferably at least 85%, more preferably at least 90% and most preferably at least 95% homologous to a polypeptide having the sequence VRGG-TAGYLGEETRGQRPGCDSQSHTGPSKKP-SAPSPLPAGTSWDRGVP (SEQ ID NO:1720) corresponding to amino acids 571-619 of M78076_PEA_1_P14 (SEQ ID NO:1353), wherein said first amino acid sequence and second amino acid sequence are contiguous and in a sequential order.

According to preferred embodiments of the present invention, there is provided an isolated polypeptide encoding for a tail of M78076_PEA_1_P14 (SEQ ID NO:1353), comprising a polypeptide being at least 70%, optionally at least about 80%, preferably at least about 85%, more preferably at least about 90% and most preferably at least about 95% homologous to the sequence VRGGTAGYLGEETRGQRPGCD-SQSHTGPSKKPSAPSPLPAGTSWDRGVP (SEQ ID NO:1720) in M78076_PEA_1_P14 (SEQ ID NO:1353).

According to preferred embodiments of the present invention, there is provided an isolated chimeric polypeptide encoding for M78076_PEA_1_P21 (SEQ ID NO:1354), comprising a first amino acid sequence being at least 90% homologous to MGPASPAARGLSRRPGQPPLPLLL-PLLLLLLRAQPAIGSLAGGSPGAAEAPGSAQVAG-LCGRLTLHRDLRT GRWEPDPQRSRRCLRDPQRVLEY-CRQMYPELQIARVEQATQAIPMERWCGGSRSGS-CAHPHHQVVPFRC LPGEFVSEALLVPEGCRFLHQER-MDQCESSTRRHQEAQEACSSQGLILHGS-GMLLPCGSDRFRGVEYVCCP PPGTPDPSGTAVGDP-STRSWPPGSRVEGAEDEEEEESFPQPVDDYFVEPPQA-EEEEETVPPPSSHTLAVVGK VTPTPRPTDGVDIYFG-MPGEISEHEGFLRAKMDLEERRMR-QINEVMREWAMADNQSKNLPKADRQALNE corresponding to amino acids 1-352 of APP1_HUMAN (SEQ ID NO:1439), which also corresponds to amino acids 1-352 of M78076_PEA_1_P21 (SEQ ID NO:1354), and a second amino acid sequence being at least 90% homologous to AERVLLALRRYLRAEQKEQRHTLRHYQH-VAAVDPEKAQQMRFQVHTHLQVIEERVN-QSLGLLDQNPHL AQELRPQIQELLHSEHLGPSELEA-PAPGGSSEDKGGLQPPDSKDDTPMTLPKGSTEQDAA-SPEKEKMNPLE QYERKVNASVPRGFPFHSSEIQRDE-LAPAGTGVSREAVSGLLIMGAGGGSLIV-LSMLLLRRKKPYGAISHG VVEVDPMLTLEEQQL-RELQRHGYENPTYRFLEERP corresponding to amino acids 406-650 of APP1_HUMAN (SEQ ID NO:1439), which also corresponds to amino acids 353-597 of M78076_PEA_1_P21 (SEQ ID NO:1354), wherein said first amino acid sequence and second amino acid sequence are contiguous and in a sequential order.

According to preferred embodiments of the present invention, there is provided an isolated chimeric polypeptide encoding for an edge portion of M78076_PEA_1_P21 (SEQ ID NO:1354), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

According to preferred embodiments of the present invention, there is provided an isolated chimeric polypeptide encoding for M78076_PEA_1_P24 (SEQ ID NO:1355), comprising a first amino acid sequence being at least 90% homologous to MGPASPAARGLSRRPGQPPLPLLL-PLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTDG-VDIYFGMPGEISEHEGFLRAKMDLEER-RMRQINEVMREWAMADNQSKNLPKADRQALNE HFQSILQTLEEQVSGERQRLVETHATRVIALIND-QRRAALEGFLAALQADPPQAERVLLALR-RYLRAEQKE QRHTLRHYQHVAAVDPEKAQQMR-FQVHTHLQVIEERVNQSLGLLDQNPHLAQELRPQI corresponding to amino acids 1-481 of APP1_HUMAN (SEQ ID NO:1439), which also corresponds to amino acids 1-481 of M78076_PEA_1_P24 (SEQ ID NO:1355), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:1721) corresponding to amino acids 482-498 of M78076_PEA_1_P24 (SEQ ID NO:1355), wherein said first amino acid sequence and second amino acid sequence are contiguous and in a sequential order.

According to preferred embodiments of the present invention, there is provided an isolated polypeptide encoding for a tail of M78076_PEA_1_P24 (SEQ ID NO:1355), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO:1721) in M78076_PEA_1_P24 (SEQ ID NO:1355).

According to preferred embodiments of the present invention, there is provided an isolated chimeric polypeptide encoding for M78076_PEA_1_P2 (SEQ ID NO:1356), comprising a first amino acid sequence being at least 90% homologous to MGPASPAARGLSRRPGQPPLPLLL-PLLLLLLRAQPAIGSLAGGSPGAAEAPGSAQVAGL-CGRLTLHRDLRT GRWEPDPQRSRRCLRDPQRVLEY-CRQMYPELQIARVEQATQAIPMERWCGGSRSG-SCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTD-GVDIYFGMPGEISEHEGFLRAKMDLEER-RMRQINEVMREWAMADNQSKNLPKADRQALNE HFQSILQTLEEQVSGERQRLVETHATRVIALIND-QRRAALEGFLAALQADPPQAERVLLALRRYLRAE-QKE QRHTLRHYQHVAAVDPEKAQQMRFQV corresponding to amino acids 1-449 of APP1_HUMAN (SEQ ID NO:1439), which also corresponds to amino acids 1-449 of M78076_PEA_1_P2 (SEQ ID NO:1356), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLF-SCPLDPLSVSWTPSYPLNTASLPLPSLSAQLPDPE-TWTLTCCVFDPCFLALG FLLPPPSILCSVPWIFT-AFPRIVFFFFFFLRQVLALSPRQESSVRSWLIATST-SWVQAILLPQPLE (SEQ ID NO: 1722) corresponding to amino acids 450-588 of M78076_PEA_1_P2 (SEQ ID NO:1356), wherein said first amino acid sequence and second amino acid sequence are contiguous and in a sequential order.

According to preferred embodiments of the present invention, there is provided an isolated polypeptide encoding for a tail of M78076_PEA_1_P2 (SEQ ID NO:1356), comprising a polypeptide being at least 70%, optionally at least about 80%, preferably at least about 85%, more preferably at least about 90% and most preferably at least about 95% homologous to the sequence LTSFQLPNAPLFLRRPRLRLFSC-PLDPLSVSWTPSYPLNTASLPLPSLSAQLPDPET-WTLTCCVFDPCFLALG FLLPPPSILCSVPWIFT-AFPRIVFFFFFFLRQVLALSPRQESSVR-SWLIATSTSWVQAILLPQPLE (SEQ ID NO: 1722) in M78076_PEA_1_P2 (SEQ ID NO:1356).

According to preferred embodiments of the present invention, there is provided an isolated chimeric polypeptide encoding for M78076_PEA_1_P25 (SEQ ID NO:1357), comprising a first amino acid sequence being at least 90% homologous to MGPASPAARGLSRRPGQPPLPLLL-PLLLLLLRAQPAIGSLAGGSPGAAEAPGSAQVAGL-CGRLTLHRDLRT GRWEPDPQRSRRCLRDPQRVLEY-CRQMYPELQIARVEQATQAIPMERWCGGSRSGSC-AHPHHQVVPFRC LPGEFVSEALLVPEGCRFLHQER-MDQCESSTRRHQEAQEACSSQGLILHGS-GMLLPCGSDRFRGVEYVCCP PPGTPDPSGTAVGDP- STRSWPPGSRVEGAEDEEEEESFPQPVDDYFVEPPQA-EEEEETVPPPSSHTLAVVGK VTPTPRPTDGVDIYFG-MPGEISEHEGFLRAKMDLEERRMR-QINEVMREWAMADNQSKNLPKADRQALNE HFQSILQTLEEQVSGERQRLVETHA-TRVIALINDQRRAALEGFLAALQADP-PQAERVLLALRRYLRAEQKE QRHTLRHYQHVAAVD-PEKAQQMRFQ corresponding to amino acids 1-448 of APP1_HUMAN (SEQ ID NO:1439), which also corresponds to amino acids 1-448 of M78076_PEA__1_P25 (SEQ ID NO:1357), and a second amino acid sequence being at least 70%, optionally at least 80%, preferably at least 85%, more preferably at least 90% and most preferably at least 95% homologous to a polypeptide having the sequence PQNPN-SQPRAAGSLEVIISHPFVRRLEIL-ISPFQFQNSIPKNSQIVPAASPRGTSSP (SEQ ID NO: 1723) corresponding to amino acids 449-505 of M78076_PEA__1_P25 (SEQ ID NO:1357), wherein said first amino acid sequence and second amino acid sequence are contiguous and in a sequential order.

According to preferred embodiments of the present invention, there is provided an isolated polypeptide encoding for a tail of M78076_PEA__1_P25 (SEQ ID NO:1357), comprising a polypeptide being at least 70%, optionally at least about 80%, preferably at least about 85%, more preferably at least about 90% and most preferably at least about 95% homologous to the sequence PQNPNSQPRAAGSLEVIISHPFVR-RLEILISPFQFQNSIPKNSQIVPAASPRGTSSP (SEQ ID NO:1723) in M78076_PEA__1_P25 (SEQ ID NO:1357).

According to preferred embodiments of the present invention, there is provided an isolated chimeric polypeptide encoding for M79217_PEA__1_P1 (SEQ ID NO:1336), comprising a first amino acid sequence being at least 90% homologous to MTGYTMLRNGGAGNGGQTCMLRWS-NRIRLTWLSFTLFVILVFFPLIAHYYLT-TLDEADEAGKRIFGPRVG NELCEVKHVLDLCRIRES-VSEELLQLEAKRQELNSEIAKLNLKIEACKKSIENAK-QDLLQLKNVISQTEHSY KELMAQNQPKLSLPIRLL-PEKDDAGLPPPKATRGCRLHNCFDYSRC-PLTSGFPVYVYDSDQFVFGSYLDPL VKQAFQAT-ARANVYVTENADIACLYVILVGEMQEPVVLRPAELE-KQLYSLPHWRTDGHNHVIINLSRKSD TQNLLYNVST-GRAMVAQSTFYTVQYRPGFDLVVS-PLVHAMSEPNFMEIPPQVPVKRKYLFTFQGEKIESLR SSLQEARSFEEEMEGDPPADYDDRII-ATLKAVQDSKLDQVLVEFTCKNQP-KPSLPTEWALCGEREDRLELL KLSTFALIITPGD-PRLVISSGCATRLFEALEVGAVPVVLGEQVQLPYQD-MLQWNEAALVVPKPRVTEVHFL LRSLSDSDLLAMR-RQGRFLWETYFSTADSIFNTVLAMIR-TRIQIPAAPIREEAAAEIPHRSGKAAGTDPNMA DNGDLDLGPVETEPPYASPRYLRN-FTLTVTDFYRSWNCAPGPFHLFPHTPFD-PVLPSEAKFLGSGTGFRPIG GGAGGSGKEFQAALG-GNVPREQFTVVMLTYEREEVLMNSLERLNGLPYLN-KVVVVWNSPKLPSEDLLW PDIGVPIMV-VRTEKNSLNNRFLPWNEIETEAILSID-DDAHLRHDEIMFGFRVWREARDRIVGFPGRYHAWDI PHQSWLYNSNYSCELSMVLTGAAFFH-KYYAYLYSYVMPQAIRDMVDEYINCEDI-AMNFLVSHITRKPPIK VTSRWTFRCPGCPQALSH-DDSHFHERHKCINFFVKVYGYMPLLYTQFRVDSVLF-KTRLPHDKTKCFKFI corresponding to amino acids 13-931 of BAA25445 (SEQ ID NO:1437), which also corresponds to amino acids 1-919 of M79217_PEA__1_P1 (SEQ ID NO:1336).

According to preferred embodiments of the present invention, there is provided an isolated chimeric polypeptide encoding for M79217_PEA__1_P2 (SEQ ID NO:1337), comprising a first amino acid sequence being at least 90% homologous to MTGYTMLRNGGAGNGGQTCMLRWS-NRIRLTWLSFTLFVILVFFPLIAHYYLTTLDEADE-AGKRIFGPRVG NELCEVKHVLDLCRIRESVSEELL-QLEAKRQELNSEIAKLNLKIEACKKS-IENAKQDLLQLKNVISQTEHSY KELMAQNQP-KLSLPIRLLPEKDDAGLPPPKATRGCR-LHNCFDYSRCPLTSGFPVYVYDSDQFVFGSYLDPL VKQAFQATARANVYVTENADIACLYVIL-VGEMQEPVVLRPAELEKQLYSL-PHWRTDGHNHVIINLSRKSD TQNLLYNVSTGRAM-VAQSTFYTVQYRPGFDLVVSPLVHAMSEPNFMEIPPQ-VPVKRKYLFTFQGEKIESLR SSLQEARSFEEEMEGD-PPADYDDRIIATLKAVQDSKLDQV-LVEFTCKNQPKPSLPTEWALCGEREDRLELL KLST-FALIITPGDPRLVISSGCATRLFEALEVGAVPVVLGEQ-VQLPYQDMLQWNEAALVVPKPRVTEVHFL LRSLS-DSDLLAMRRQGRFLWETYFSTADSIFNTVLAMI-RTRIQIPAAPIREEAAAEIPHRSGKAAGTDPNMA DNGDLDLGPVETEPPYASPRYLRNFTLTVTDFY-RSWNCAPGPFHLFPHTPFDPVLPSEAK-FLGSGTGFRPIG GGAGGSGKEFQAALGGNVPREQ-FTVVMLTYEREEVLMNSLERLNGLPYLNKVVVV-WNSPKLPSEDLLW PDIGVPIMVVRTEKNSLNNRFLP-WNEIETEAILSIDDDAHLRHDEIMFG-FRVWREARDRIVGFPGRYHAWDI PHQSWLYNSNY-SCELSMVLTGAAFFHK corresponding to amino acids 1-807 of EXL3_HUMAN (SEQ ID NO:1436), which also corresponds to amino acids 1-807 of M79217_PEA__1_P2 (SEQ ID NO:1337), and a second amino acid sequence being at least 90% homologous to AIRDMVDEYINCEDIAMN-FLVSHITRKPPIKVTSRWT-FRCPGCPQALSHDDSHFHERHKCINFFVKVYGYM PLLYTQFRVDSVLFKTRLPHDKTKCFKFI corresponding to amino acids 820-919 of EXL3_HUMAN (SEQ ID NO:1436), which also corresponds to amino acids 808-907 of M79217_PEA__1_P2 (SEQ ID NO:1337), wherein said first amino acid sequence and second amino acid sequence are contiguous and in a sequential order.

According to preferred embodiments of the present invention, there is provided an isolated chimeric polypeptide encoding for an edge portion of M79217_PEA__1_P2 (SEQ ID NO:1337), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KA, having a structure as follows: a sequence starting from any of amino acid numbers 807-x to 807; and ending at any of amino acid numbers 808+((n−2)−x), in which x varies from 0 to n−2.

According to preferred embodiments of the present invention, there is provided an isolated chimeric polypeptide encoding for M79217_PEA__1_P4 (SEQ ID NO:1338), comprising a first amino acid sequence being at least 70%, optionally at least 80%, preferably at least 85%, more preferably at least 90% and most preferably at least 95% homologous to a polypeptide having the sequence PELRQPAR-LGLPECWDYRHEPRCPAQMGSHFIVQA-GLKLLASSKPPKCWDY (SEQ ID NO:1724) corresponding to amino acids 1-51 of M79217_PEA__1_P4 (SEQ ID NO:1338), and a second amino acid sequence being at least 90% homologous to RVWREARDRIVGFPGRYHAWD- IPHQSWLYNSNYSCELSMVLTGAAFFHKYYAYL-YSYVMPQAIRDMVD EYINCEDIAMNFLVSHITRKP-PIKVTSRWTFRCPGCPQALSHDDSHFHERHKCINF-FVKVYGYMPLLYTQFR VDSVLFKTRLPHDKT-KCFKFI corresponding to amino acids 759-919 of EXL3_HUMAN (SEQ ID NO:1436), which also corresponds to amino acids 52-212 of M79217_PEA_1_P4 (SEQ ID NO:1338), wherein said first amino acid sequence and second amino acid sequence are contiguous and in a sequential order.

According to preferred embodiments of the present invention, there is provided an isolated polypeptide encoding for a head of M79217_PEA_1_P4 (SEQ ID NO:1338), comprising a polypeptide being at least 70%, optionally at least about 80%, preferably at least about 85%, more preferably at least about 90% and most preferably at least about 95% homogous to the sequence PELRQPARLGLPECWDYRHEPRC-PAQMGSHFIVQAGLKLLASSKPPKCWDY (SEQ ID NO:1724) of M79217_PEA_1_P4 (SEQ ID NO:1338).

According to preferred embodiments of the present invention, there is provided an isolated chimeric polypeptide encoding for M79217_PEA_1_P8 (SEQ ID NO:1339), comprising a first amino acid sequence being at least 90% homologous to MTGYTMLRNGGAGNGGQTCMLRWS-NRIRLTWLSFTLFVILVFFPLIAHYYLT-TLDEADEAGKRIFGPRVG NELCEVKHVLDLCRIRES-VSEELLQLEAKRQELNSEIAKLNLKIEACKKSIENAK-QDLLQLKNVISQTEHSY KELMAQNQPKLSLPIRLL-PEKDDAGLPPPKATRGCRLHNCFDYSRC-PLTSGFPVYVYDSDQFVFGSYLDPL VKQAFQAT-ARANVYVTENADIACLYVILVGEMQEPVVLRPAELE-KQLYSLPHWRTDGHNHVIINLSRKSD TQNLLYNVST-GRAMVAQSTFYTVQYRPGFDLVVS-PLVHAMSEPNFMEIPPQVPVKRKYLFTFQGEKIESLR SSLQEARSFEEEMEGDPPADYDDRII-ATLKAVQDSKLDQVLVEFTCKNQP-KPSLPTEWALCGEREDRLELL KLSTFALIITPGD-PRLVISSGCATRLFEALEVGAVPVVLGEQVQLPYQD-MLQWNEAALVVPKPRVTEVHFL LRSLSDSDLLAMR-RQGRFLWETYFSTADSIFNTVLAMIR-TRIQIPAAPIREEAAAEIPHRSGKAAGTDPNMA DNGDLDLGPVETEPPYASPRYLRN-FTLTVTDFYRSWNCAPGPFHLFPHTPFD-PVLPSEAKFLGSGTGFRPIG GGAGGSGKEFQAALG-GNVPREQFTVVMLTYEREEVLMNSLERLNGLPYLN-KVVVVWNSPKLPSEDLLW PDIGVPIMV-VRTEKNSLNNRFLPWNEIETEAILSID-DDAHLRHDEIMFGFRVWREARDRIVGFPGRYHAWDI PHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P8 (SEQ ID NO:1339), and a second amino acid sequence being at least 70%, optionally at least 80%, preferably at least 85%, more preferably at least 90% and most preferably at least 95% homologous to a polypeptide having the sequence VRKSW (SEQ ID NO:1725) corresponding to amino acids 808-812 of M79217_PEA_1_P8 (SEQ ID NO:1339), wherein said first amino acid sequence and second amino acid sequence are contiguous and in a sequential order.

According to preferred embodiments of the present invention, there is provided an isolated polypeptide encoding for a tail of M79217_PEA_1_P8 (SEQ ID NO:1339), comprising a polypeptide being at least 70%, optionally at least about 80%, preferably at least about 85%, more preferably at least about 90% and most preferably at least about 95% homologous to the sequence VRKSW (SEQ ID NO:1725) in M79217_PEA_1_P8 (SEQ ID NO:1339).

According to preferred embodiments of the present invention, there is provided an isolated chimeric polypeptide encoding for M62096_PEA_1_P4 (SEQ ID NO:1341), comprising a first amino acid sequence being at least 70%, optionally at least 80%, preferably at least 85%, more preferably at least 90% and most preferably at least 95% homologous to a polypeptide having the sequence MATYIH (SEQ ID NO:1726) corresponding to amino acids 1-6 of M62096_PEA_1_P4 (SEQ ID NO:1341), and a second amino acid sequence being at least 90% homologous to VSK-TGAEGAVLDEAKNINKSLSALGNVISALAEGTK-THVPYRDSKMTRILQDSLGGNCRTTIVICCSPSVFN EAETKSTLMFGQRAKTIKNTVSVNLELTAEEW-KKKYEKEKEKNKTLKNVIQHLEMELNRWRNGE-AVPED EQISAKDQKNLEPCDNTPIIDNIAPVVAGISTE-EKEKYDEEISSLYRQLDDKDDEINQQSQLAEK-LKQQMLD QDELLASTRRDYEKIQEELTRLQIENE-AAKDEVKEVLQALEELAVNYDQKSQEVEDKTPAN-EQLTDELAQ KTTTLTTTQRELSQLQELSN-HQKKRATEILNLLLKDLGEIGGIIGTNDVKTLAD-VNGVIEEEFTMARLYISK MKSEVKSLVNRSKQLE-SAQMDSNRKMNASERELAACQLLISQHEAKI-KSLTDYMQNMEQKRRQLEESQD SLSEELAKLRAQE-KMHEVSFQDKEKEHLTRLQDAEEMKKALEQ-QMESHREAHQKQLSRLRDEIEEKQKII DEIRDLN-QKLQLEQEKLSSDYNKLKIEDQEREMKLEKLLLLN-DKREQAREDLKGLEETVSRELQTLHNLR KLFVQDLTTRVKKSVELDNDDGGGSAAQKQ-KISFLENNLEQLTKVHKQLVRDNADLRCELPKLE-KRLRA TAERVKALESALKEAKENAM-RDRKRYQQEVDRIKEAVRAKNMARRAHSAQIAKP-IRPGHYPASSPTAVH AIRGGGGSSSNSTHYQK corresponding to amino acids 239-957 of KF5C_HUMAN (SEQ ID NO:1438), which also corresponds to amino acids 7-725 of M62096_PEA_1_P4 (SEQ ID NO:1341), wherein said first amino acid sequence and second amino acid sequence are contiguous and in a sequential order.

According to preferred embodiments of the present invention, there is provided an isolated polypeptide encoding for a head of M62096_PEA_1_P4 (SEQ ID NO:1341), comprising a polypeptide being at least 70%, optionally at least about 80%, preferably at least about 85%, more preferably at least about 90% and most preferably at least about 95% homologous to the sequence MATYIH (SEQ ID NO:1726) of M62096_PEA_1_P4 (SEQ ID NO:1341).

According to preferred embodiments of the present invention, there is provided an isolated chimeric polypeptide encoding for M62096_PEA_1_P5 (SEQ ID NO:1342), comprising a first amino acid sequence being at least 90% homologous to MTRILQDSLGGNCRTTIVICCSPS-VFNEAETKSTLMFGQRAKTIKNTVSVNLELTAEE-WKKKYEKEKEKNK TLKNVIQHLEMELNR-WRNGEAVPEDEQISAKDQKNLEPCDNTPIIDNIAP-VVAGISTEEKEKYDEEISSLYR QLDDKDDEIN-QQSQLAEKLKQQMLDQDELLASTRRDYEKIQE-ELTRLQIENEAAKDEVKEVLQALEELAV NYDQK-SQEVEDKTRANEQLTDELAQKTTTLTTTQRELSQL-QELSNHQKKRATEILNLLLKDLGEIGGIIGT NDVKT-LADVNGVIEEEFTMARLYISKMKSEVKSLVNRSK-QLESAQMDSNRKMNASERELAACQLLISQHE AKIK-SLTDYMQNMEQKRRQLEESQDSLSEELAKLRA-QEKMHEVSFQDKEKEHLTRLQDAEEMKKALEQQ MESHREAHQKQLSRLRDEIEEKQKIIDEIRDLNQ-KLQLEQEKLSSDYNKLKIEDQEREMKLEKLLLLN-DKR EQAREDLKGLEETVSRELQTLHNLRKLFVQD- LTTRVKKSVELDNDDGGGSAAQKQKISFLENNLEQLTKV HKQLVRDNADLRCELPKLEKRLRATAERVKALESALKEAKENAMRDRKRYQQEVDRIKEAVRAKNMAR RAHSAQIAKPIRPGHYPASSPTAVHAIRGGGGSSSNSTHYQK corresponding to amino acids 284-957 of KF5C_HUMAN (SEQ ID NO:1438), which also corresponds to amino acids 1-674 of M62096_PEA__1_P5 (SEQ ID NO:1342).

According to preferred embodiments of the present invention, there is provided an isolated chimeric polypeptide encoding for M62096_PEA__1_P3 (SEQ ID NO:1343), comprising a first amino acid sequence being at least 90% homologous to MELNRWRNGEAVPEDEQISAKDQKNLEPCDNTPIIDNIAPVVAGISTEEKEKYDEEISSLYRQLDDKDDEIN QQSQLAEKLKQQMLDQDELLASTRRDYEKIQEELTRLQIENEAA-KDEVKEVLQALEELAVNYDQKSQEV EDKTRANEQLTDELAQKTTTLTTTQRELSQLQELSNHQKKRATEILNLLLKDLGEIGGIIGTNDVKTLADV NGVIEEEFTMARLYISKMKSEVKSLVNRSKQLESAQMDSNRKMNASERELAACQLLISQHEAKIKSLTDY MQNMEQKRRQLEESQDSLSEELAKLRAQEKMHEVSFQDKEKEHLTRLQDAEEMKKALEQQMESHREAH QKQLSRLRDEIEEKQKIIDEIRDLNQKLQLEQEKLSSDYNKLKIEDQEREMKLEKLLLLNDKREQAREDLK GLEETVSRELQTLHNLRKLFVQDLTTRVKKSVELDNDDGGGSAAQKQKISFLENNLEQLTKVHKQLVRD NADLRCELPKLEKRLRATAERVKALESALKEAKENAMRDRKRYQQEVDRIKEAVRAKNMARRAHSAQI AKPIRPGHYPASSPTAVHAIRGGGGSSSNSTHYQK corresponding to amino acids 365-957 of KF5C_HUMAN (SEQ ID NO:1438), which also corresponds to amino acids 1-593 of M62096_PEA__1_P3 (SEQ ID NO:1343).

According to preferred embodiments of the present invention, there is provided an isolated chimeric polypeptide encoding for M62096_PEA__1_P7 (SEQ ID NO:1344), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO: 1727) corresponding to amino acids 1-19 of M62096_PEA__1_P7 (SEQ ID NO:1344), and a second amino acid sequence being at least 90% homologous to LNQKLQLEQEKLSSDYNKLKIEDQEREMKLEKLLLLNDKREQAREDLKGLEETVSRELQTLHNLRKLFVQ DLTTRVKKSVELDNDDGGGSAAQKQKISFLENNLEQLTKVHKQLVRDNADLRCELPKLEKRLRATAERV KALESALKEAKENAMRDRKRYQQEVDRIKEAVRAKNMARRAHSAQIAKPIRPGHYPASSPTAVHAIRGG GGSSSNSTHYQK corresponding to amino acids 738-957 of KF5C_HUMAN (SEQ ID NO:1438), which also corresponds to amino acids 20-239 of M62096_PEA__1_P7 (SEQ ID NO:1344), wherein said first amino acid sequence and second amino acid sequence are contiguous and in a sequential order.

According to preferred embodiments of the present invention, there is provided an isolated polypeptide encoding for a head of M62096_PEA__1_P7 (SEQ ID NO:1344), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO: 1727) of M62096_PEA__1_P7 (SEQ ID NO:1344).

According to preferred embodiments of the present invention, there is provided an isolated chimeric polypeptide encoding for M62096_PEA__1_P8 (SEQ ID NO:1345), comprising a first amino acid sequence being at least 90% homologous to MADPAECSIKVMCRFRPLNEAEILRGDKFIPKFKGDETVVIGQGKPYVFDRVLPPNTTQEQVYNACAKQIV KDVLEGYNGTIFAYGQTSSGKTHTMEGKLHDPQLMGIIPRIAHDIFDHIYSMDENLEFHIKVSYFEIYLDKIR DLLDVSKTNLAVHEDKNRVPYVKGCTERFVSSPEEVMDVIDEGKANRHVAVTNMNEHSSRSHSIFLINIK QENVETEKKLSGKLYLVDLAGSEKVSKTGAEGAVLDEAKNINKSLSALGNISALAEGTKTHVPYRDSKM TRILQDSLGGNCRTTIVICCSPSVFNEAETKSTLMFGQRAKTIKNTVSVNLELTAEEWKKKYEKEKEKNKT LKNVIQHLEMELNRWRNGEAVPEDEQISAKDQKNLEPCDNTPIIDNIAPVVAGISTEEKEKYDEEISSLYRQ LDDKDDEINQQSQLAEKLKQQMLDQDELLASTRRDYEKIQEELTRLQIENEAAKDEVKEVLQALEELAVN YDQKSQEVEDKTRANEQLTDELAQKTTTLTTTQRELSQLQELSNHQKKRATEILNLLLKDLGEIGGIIGTN DVKTLADVNGVIEEEFTMARLYISKMKSEVKSLVNRSKQLESAQMDSNRKMNASERELAACQLLISQHEA KIKSLTDYMQNMEQKRRQLEESQDSLSEELAKLRAQEKMHEVSFQDKEKEHLTRLQDAEEMKKALEQQ MESHREAHQKQLSRLRDEIEEKQKIIDEIR corresponding to amino acids 1-736 of KF5C_HUMAN (SEQ ID NO:1438), which also corresponds to amino acids 1-736 of M62096_PEA__1_P8 (SEQ ID NO:1345), and a second amino acid sequence being at least 70%, optionally at least 80%, preferably at least 85%, more preferably at least 90% and most preferably at least 95% homologous to a polypeptide having the sequence E corresponding to amino acids 737-737 of M62096_PEA__1_P8 (SEQ ID NO:1345), wherein said first amino acid sequence and second amino acid sequence are contiguous and in a sequential order.

According to preferred embodiments of the present invention, there is provided an isolated chimeric polypeptide encoding for M62096_PEA__1_P9 (SEQ ID NO:1346), comprising a first amino acid sequence being at least 90% homologous to MADPAECSIKVMCRFRPLNEAEILRGDKFIPKFKGDETVVIGQGKPYVFDRVLPPNTTQEQVYNACAKQIV KDVLEGYNGTIFAYGQTSSGKTHTMEGKLHDPQLMGIIPRIAHDIFDHIYSMDENLEFHIKVSYFEIYLDKIR DLLDVSKTNLAVHEDKNRVPYVKGCTERFVSSPEEVMDVIDEGKANRHVAVTNMNEHSSRSHSIFLINIK QENVETEKKLSGKLYLVDLAGSEKVSKTGAEGAVLDEAKNINKSLSALGNVISALAEGTKTHVPYRDSKM TRILQDSLGGNCRTTIVICCSPSVFNEAETKSTLMFGQRAKTIKNTVSVNLELTAEEWKKKYEKEKEKNKT LKNVIQHLEMELNRWRNGEAVPEDEQISAKDQKNLEPCDNTPIIDNIAPVVAGISTEEKEKYDEEISSLYRQ LDDKDDEINQQSQLAEKLKQQMLDQDE corresponding to amino acids 1-454 of KF5C_HUMAN (SEQ ID NO:1438), which also corresponds to amino acids 1-454 of M62096_PEA__1_P9 (SEQ ID NO:1346), and a second amino acid sequence being at least 70%, optionally at least 80%, preferably at least 85%, more preferably at least 90% and most preferably at least 95% homologous to a polypeptide having the sequence VKNAIYFFFHKVLLLLFVVDVCSRNLIGIEAFHNYRIMWKFLGRCPFTASYKLIITEFRK (SEQ ID NO:1728) corresponding to amino acids 455-514 of M62096_PEA_1_P9 (SEQ ID NO:1346), wherein said first amino acid sequence and second amino acid sequence are contiguous and in a sequential order.

According to preferred embodiments of the present invention, there is provided an isolated polypeptide encoding for a tail of M62096_PEA_1_P9 (SEQ ID NO:1346), comprising a polypeptide being at least 70%, optionally at least about 80%, preferably at least about 85%, more preferably at least about 90% and most preferably at least about 95% homologous to the sequence VKNAIYFFFHKVLLLLFVVDVCS-RNLIGIEAFHNYRIMWKFLGRCPFTASYKLIITEFRK (SEQ ID NO:1728) in M62096_PEA_1_P9 (SEQ ID NO:1346).

According to preferred embodiments of the present invention, there is provided an isolated chimeric polypeptide encoding for M62096_PEA_1_P10 (SEQ ID NO:1347), comprising a first amino acid sequence being at least 70%, optionally at least 80%, preferably at least 85%, more preferably at least 90% and most preferably at least 95% homologous to a polypeptide having the sequence MTQNFRLMW-NILLFPLNFS (SEQ ID NO:1727) corresponding to amino acids 1-19 of M62096_PEA_1_P10 (SEQ ID NO:1347), a second amino acid sequence being at least 90% homologous to LNQKLQLEQEKLSSDYNKLKIEDQEREMKLE-KLLLLNDKREQAREDLKGLEETVSRELQTLHNL-RKLFVQ DLTTRVKK corresponding to amino acids 738-815 of KF5C_HUMAN (SEQ ID NO:1438), which also corresponds to amino acids 20-97 of M62096_PEA_1_P10 (SEQ ID NO:1347), and a third amino acid sequence being at least 70%, optionally at least 80%, preferably at least 85%, more preferably at least 90% and most preferably at least 95% homologous to a polypeptide having the sequence VSS-LCLNGTEKKIKDGREESFSVEISLA (SEQ ID NO:1730) corresponding to amino acids 98-125 of M62096_PEA_1_P10 (SEQ ID NO:1347), wherein said first amino acid sequence, second amino acid sequence and third amino acid sequence are contiguous and in a sequential order.

According to preferred embodiments of the present invention, there is provided an isolated polypeptide encoding for a head of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P10 (SEQ ID NO:1347).

According to preferred embodiments of the present invention, there is provided an isolated polypeptide encoding for a tail of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence VSSLCLNGTEKKIKDGREESFS-VEISLA (SEQ ID NO:1730) in M62096_PEA_1_P10 (SEQ ID NO:1347).

According to preferred embodiments of the present invention, there is provided an isolated chimeric polypeptide encoding for M62096_PEA_1_P11 (SEQ ID NO:1348), comprising a first amino acid sequence being at least 90% homologous to MADPAECSIKVMCRFRPLNEAEILRGD-KFIPKFKGDETVVIGQGKPYVFDRVLPPNTTQEQV-YNACAKQIV KDVLEGYNGTIFAYGQTSSGKTHT-MEGKLHDPQLMGIIPRIAHDIFDHIYSMDENLEF-HIKVSYFEIYLDKIR DLLDVSKTNLAVHEDKN-RVPYVKGCTERFVSSPEEVMDVIDEGKANRHVA-VTNMNEHSSRSHSIFLINIK QENVETEKKLSGK-LYLVDLAGSEKVSKTGAEGAVLDEAKNINKS-LSALGNVISALAEGTKTHVPYRDSKM TRILQDSLG-GNCRTTIVICCSPSVFNEAETKSTLMFGQRAKTIK-NTVSVNLELTAEEWKKKYEKEKEKNKT LKN-VIQHLEMELNRWRN corresponding to amino acids 1-372 of KF5C_HUMAN (SEQ ID NO:1438), which also corresponds to amino acids 1-372 of M62096_PEA_1_P11 (SEQ ID NO:1348), and a second amino acid sequence being at least 70%, optionally at least 80%, preferably at least 85%, more preferably at least 90% and most preferably at least 95% homologous to a polypeptide having the sequence DFLAAH-VFGKLLE (SEQ ID NO: 1731) corresponding to amino acids 373-385 of M62096_PEA_1_P11 (SEQ ID NO:1348), wherein said first amino acid sequence and second amino acid sequence are contiguous and in a sequential order.

According to preferred embodiments of the present invention, there is provided an isolated polypeptide encoding for a tail of M62096_PEA_1_P11 (SEQ ID NO:1348), comprising a polypeptide being at least 70%, optionally at least about 80%, preferably at least about 85%, more preferably at least about 90% and most preferably at least about 95% homologous to the sequence DFLAAHVFGKLLE (SEQ ID NO: 1731) in M62096_PEA_1_P11 (SEQ ID NO:1348).

According to preferred embodiments of the present invention, there is provided an isolated chimeric polypeptide encoding for M62096_PEA_1_P12 (SEQ ID NO:1349), comprising a first amino acid sequence being at least 90% homologous to MADPAECSIKVMCRFRPLNEAEILRGD-KFIPKFKGDETVVIGQGKPYVFDRVLPPNTTQEQV-YNACAKQIV KDVLEGYNGTIFAYGQTSSGKTHT-MEGKLHDPQLMGIIPRIAHDIFDHIYSMDENLEF-HIKVSYFEIYLDKIR DLLDVSKTNLAVHEDKN-RVPYVKGCTERFVSSPEEVMDVIDEGKANRHV-AVTNMNEHSSRSHSIFLINIK QENVETEKKLSGK-LYLVDLAGSEKVSKTGAEGAVLDEAKNINKSLS-ALGNVISALAEGTKTHVPYRDSKM TRILQDSLGGN-CRTTIVICCSPSVFNEAETKSTLMFGQR corresponding to amino acids 1-323 of KF5C_HUMAN (SEQ ID NO:1438), which also corresponds to amino acids 1-323 of M62096_PEA_1_P12 (SEQ ID NO:1349), and a second amino acid sequence being at least 70%, optionally at least 80%, preferably at least 85%, more preferably at least 90% and most preferably at least 95% homologous to a polypeptide having the sequence V corresponding to amino acids 324-324 of M62096_PEA_1_P12 (SEQ ID NO:1349), wherein said first amino acid sequence and second amino acid sequence are contiguous and in a sequential order.

According to preferred embodiments of the present invention, there is provided an isolated chimeric polypeptide encoding for T99080_PEA_4_P5 (SEQ ID NO:1360), comprising a first amino acid sequence being at least 70%, optionally at least 80%, preferably at least 85%, more preferably at least 90% and most preferably at least 95% homologous to a polypeptide having the sequence MPASARLA-GAGLLLAFLRALGCAGRAPGLS (SEQ ID NO:1732) corresponding to amino acids 1-30 of T99080_PEA_4_P5 (SEQ ID NO:1360), and a second amino acid sequence being at least 90% homologous to MAEGNTLISVDYEIF-GKVQGVFFRKHTQAEGKKLGLVGWVQNT-DRGTVQGQLQGPISKVRHMQEWLET RGSPKSHID-KANFNNEKVILKLDYSDFQIVK corresponding to amino acids 1-99 of ACYO_HUMAN_V1 (SEQ ID NO:1441), which also corresponds to amino acids 31-129 of T99080_PEA_4_P5 (SEQ ID NO:1360), wherein said first amino acid sequence and second amino acid sequence are contiguous and in a sequential order.

According to preferred embodiments of the present invention, there is provided an isolated polypeptide encoding for a head of T99080_PEA_4_P5 (SEQ ID NO:1360), comprising a polypeptide being at least 70%, optionally at least about 80%, preferably at least about 85%, more preferably at least about 90% and most preferably at least about 95% homologous to the sequence MPASARLAGAGLLLAFLRALGCA-GRAPGLS (SEQ ID NO: 1732) of T99080_PEA_4_P5 (SEQ ID NO:1360).

According to preferred embodiments of the present invention, there is provided an isolated chimeric polypeptide encoding for T99080_PEA_4_P8 (SEQ ID NO:1361), comprising a first amino acid sequence being at least 70%, optionally at least 80%, preferably at least 85%, more preferably at least 90% and most preferably at least 95% homologous to a polypeptide having the sequence M corresponding to amino acids 1-1 of T99080_PEA_4_P8 (SEQ ID NO:1361), and a second amino acid sequence being at least 90% homologous to QAEGKKLGLVGWVQNTDRGTVQGQLQG-PISKVRHMQEWLETRGSPKSHIDKANFN-NEKVILKLDYSDFQ IVK corresponding to amino acids 28-99 of ACYO_HUMAN_V1 (SEQ ID NO:1441), which also corresponds to amino acids 2-73 of T99080_PEA_4_P8 (SEQ ID NO:1361), wherein said first amino acid sequence and second amino acid sequence are contiguous and in a sequential order.

According to preferred embodiments of the present invention, there is provided an isolated chimeric polypeptide encoding for T08446_PEA_1_P18 (SEQ ID NO:1370), comprising a first amino acid sequence being at least 90% homologous to MLSLSLCSHLWGPLILSALQARSTD-SLDGPGEGSVQPLPTAGGPSVKGKPGKRLSA-PRGPFPRLADCAHFH YENVDFGHIQLLLSPDREGP-SLSGENELVFGVQVTCQGRSWPVLRSYD-DFRSLDAHLHRCIFDRRFSCLPEL PPPPEGARAAQM-LVPLLLQYLETLSGLVDSNLNCGPVLTWME corresponding to amino acids 1-185 of SNXQ_HUMAN (SEQ ID NO:1442), which also corresponds to amino acids 1-185 of T08446_PEA_1_P18 (SEQ ID NO:1370), and a second amino acid sequence being at least 70%, optionally at least 80%, preferably at least 85%, more preferably at least 90% and most preferably at least 95% homologous to a polypeptide having the sequence LDNHGRRLLLSEEA-SLNIPAVAAAHVIKRYTAQAPDELSFE-VGDIVSVIDMPPTEDRSWWRGKRGFQVGFF PSECVELFTERPGPGLKADADGPPCGI-PAPQGISSSLTSAVPRPRGKLAGLLRT-FMRSRPSRQRLRQRGILRQR VFGCDLGEHLSNSGQD-VPQVLRCCSEFIEAHGVVDGIYRLSGVSSNIQRLRHE-FDSERIPELSGPAFLQDIHS VSSLCKLYFRELPN-PLLTYQLYGKFSEAMSVPGEEERLVRVH-DVIQQLPPPHYRTLEYLLRHLARMARHSA NTSM-HARNLAIVWAPNLLRSMELESVGMGGAAAFREVRV-QSVVVEFLLTHVDVLFSDTFTSAGLDPAGR CLL-PRPKSLAGSCPSTRLLTLEEAQARTQGRLGTPTE-PTTPKAPASPAERRKGERGEKQRKPGGSSWKTFF ALGRGPSVPRKKPLPWLGGTRAPPQPSGSRPDTV-TLRSAKSEESLSSQASGAGLQRLHRLRRPHSSS-DAFPV GPAPAGSCESLSSSSSSESSSSESSSSSS-ESSAAGLGALSGSPSHRTSAWLDDGDELDFSPPRCL-EGLRGLDFD PLTFRCSSPTPGDPAPPASPAPPAPASA-FPPRVTPQAISPRGPTSPASPAALDIS-EPLAVSVPPAVLELLGAGG APASATPTALSPGRSLR-PHLIPLLLRGAEAPLTDACQQEMCSKLRGAQGPLGP-DMESPLPPPPLSLLRPGG APPPPPKNPARLMALA-LAERAQQVAEQQSQQECGGTPPASQSPF-HRSLSLEVGGEPLGTSGSGPPPNSLAH PGAWVPGPP-PYLPRQQSDGSLLRSQRPMGTSRRGLRGPAQVSAQL-RAGGGGRDAPEAAAQSPCSVPSQVP TPGFFSPAPRE-CLPPFLGVPKPGLYPLGPPSFQPSSPA-
PVWRSSLGPPAPLDRGENLYYEIGASEGSPYSGPTR SWSPFRSMPPDRLNASYGMLGQSPPLHR-SPDFLLSYPPAPSCFPPDHLGYSAPQH-PARRPTPPEPLYVNLAL GPRGPSPASSSSSSPPAH-PRSRSDPGPPVPRLPQKQRAPWGPRTPHRVPGPWGP-PEPLLLYRAAPPAYGRGG ELHRGSLYRNGGQRGE-GAGPPPPYPTPSWSLHSEGQTRSYC (SEQ ID NO:1733) corresponding to amino acids 186-1305 of T08446_PEA_1_P18 (SEQ ID NO:1370), wherein said first amino acid sequence and second amino acid sequence are contiguous and in a sequential order.

According to preferred embodiments of the present invention, there is provided an isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence LDNHGRRLLLSEEA-SLNIPAVAAAHVIKRYTAQAPDELSFE-VGDIVSVIDMPPTEDRSWWRGKRGFQVGFF PSECVELFTERPGPGLKADADGPPCGI-PAPQGISSSLTSAVPRPRGKLAGLLRT-FMRSRPSRQRLRQRGILRQR VFGCDLGEHLSNSGQD-VPQVLRCCSEFIEAHGVVDGIYRLSGVSSNIQRLRHE-FDSERIPELSGPAFLQDIHS VSSLCKLYFRELPN-PLLTYQLYGKFSEAMSVPGEEERLVRVH-DVIQQLPPPHYRTLEYLLRHLARMARHSA NTSM-HARNLAIVWAPNLLRSMELESVGMGGAAAFREVRV-QSVVVEFLLTHVDVLFSDTFTSAGLDPAGR CLL-PRPKSLAGSCPSTRLLTLEEAQARTQGRLGTPTEP-TTPKAPASPAERRKGERGEKQRKPGGSSWKTFF ALGRGPSVPRKKPLPWLGGTRAPPQPSGSRPDTVT-LRSAKSEESLSSQASGAGLQRLHRLRRPHSSSDAFPV GPAPAGSCESLSSSSSSESSSSESSSSSESSAAGLG-ALSGSPSHRTSAWLDDGDELDFSPPRCLEGLRGLDFD PLTFRCSSPTPGDPAPPASPAPPAPASAFPPRVTPQ-AISPRGPTSPASPAALDISEPLAVSVPPAVLELLGAGG APASATPTALSPGRSLRPHLIPLLLRGAEAPLTDACQ-QEMCSKLRGAQGPLGPDMESPLPPPPLSLLRPGG APPPPPKNPARLMALALAERAQQVAEQQSQQ-ECGGTPPASQSPFHRSLSLEVGGEPLGTSGSG-PPPNSLAH PGAWVPGPPPYLPRQQSDGSLLRSQRP-MGTSRRGLRGPAQVSAQLRAGGGGRDAPEAAAQS-PCSVPSQVP TPGFFSPAPRECLPPFLGVPKPGLYPLG-PPSFQPSSPAPVWRSSLGPPAPLDRGEN-LYYEIGASEGSPYSGPTR SWSPFRSMPPDRLNASYG-MLGQSPPLHRSPDFLLSYPPAPSCFPPDHLGYSAPQH-PARRPTPPEPLYVNLAL GPRGPSPASSSSSSPPAH-PRSRSDPGPPVPRLPQKQRAPWGPRT-PHRVPGPWGPPEPLLLYRAAPPAYGRGG ELHRGSLYRNGGQRGEGAGPPP-PYPTPSWSLHSEGQTRSYC (SEQ ID NO:1733) in T08446_PEA_1_P18 (SEQ ID NO:1370).

According to preferred embodiments of the present invention, there is provided an isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHL-WGPLILSALQARSTDSLDGPGEGSVQPLPTAGGPSVK-GKPGKRLSAPRGPFPRLADCAHFH YENVDFGHIQL-LLSPDREGPSLSGENELVFGVQVTCQGR-SWPVLRSYDDFRSLDAHLHRCIFDRRFSCLPEL PPPPEGARAAQMLVPLLLQYLETLS-GLVDSNLNCGPVLTWMELDNHGRRLLL-SEEASLNIPAVAAAHVIK RYTAQAPDELSFEVGDIVS- VIDMPPTEDRSWWRGKRGFQVGFFPSECVELFTERPGPGLKADADGPPCGIP APQGISSLTSAVPRPRGKLAGLLRTFMRSRPSRQRLRQRGILRQRVFGCDLGEHLSNSGQDVPQVLRCCSEF IEAHGVVDGIYRLSGVSSNIQRLRHEFDSERIPELSGPAFLQDIHSVSSLCKLYFRELPNPLLTYQLYGKFSEA MSVPGEEERLVRV (SEQ ID NO:1734) corresponding to amino acids 1-443 of T08446_PEA_1_P18 (SEQ ID NO:1370), a second amino acid sequence being at least 90% homologous to HDVIQQLPPPHYRTLEYLLRHLARMARHSANTSMHARNLAIVWAPNLLRSMELESVGMGGAAAFREVRV QSVVVEFLLTHVDVLFSDTFTSAGLDPAGRCLLPRPKSLAGSCPSTRLLTLEEAQARTQGRLGTPTEPTTPK APASPAERRKGERGEKQRKPGGSSWKTFFALGRGPSVPRKKPLPWLGGTRAPPQPSGSRPDTVTLRSAKSE ESLSSQASGAGLQRLHRLRRPHSSSDAFPVGPAPAGSCESLSSSSSSESSSSESSSSSESSAAGLGALSGSPS HRTSAWLDDGDELDFSPPRCLEGLRGLDFDPLTFRCSSPTPGDPAPPASPAPPAPASAFPPRVTPQAISPRGP TSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQV SAQLRAGGGGRDAPEAAAQSPCSVPSQVPTPGFFSPAPRECLPPFLGVPKPGLYPLGPPSFQPSSPAPVWRS SLGPPAPLDRGENLYYEIGASEGSPYSG corresponding to amino acids 1-674 of Q9NT23 (SEQ ID NO:1443), which also corresponds to amino acids 444-1117 of T08446_PEA_1_P18 (SEQ ID NO:1370), a bridging amino acid P corresponding to amino acid 1118 of T08446_PEA_1_P18 (SEQ ID NO:1370), and a third amino acid sequence being at least 90% homologous to TRSWSPFRSMPPDRLNASYGMLGQSPPLHRSPDFLLSYPPAPSCFPPDHLGYSAPQHPARRPTPPEPLYVNL ALGPRGPSPASSSSSSPPAHPRSRSDPGPPVPRLPQKQRAPWGPRTPHRVPGPWGPPEPLLLYRAAPPAYGR GGELHRGSLYRNGGQRGEGAGPPPPYPTPSWSLHSEGQTRSYC corresponding to amino acids 676-862 of Q9NT23 (SEQ ID NO:1443), which also corresponds to amino acids 1119-1305 of T08446_PEA_1_P18 (SEQ ID NO:1370), wherein said first amino acid sequence, second amino acid sequence, bridging amino acid and third amino acid sequence are contiguous and in a sequential order.

According to preferred embodiments of the present invention, there is provided an isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTDSLDGPGEGSVQPLPTAGGPSVKGKPGKRLSAPRGPFPRLADCAHFH YENVDFGHIQLLLSPDREGPSLSGENELVFGVQVTCQGRSWPVLRSYDDFRSLDAHLHRCIFDRRFSCLPEL PPPPEGARAAQMLVPLLLQYLETLSGLVDSNLNCGPVLTWMELDNHGRRLLLSEEASLNIPAVAAAHVIK RYTAQAPDELSFEVGDIVSVIDMPPTEDRSWWRGKRGFQVGFFPSECVELFTERPGPGLKADADGPPCGIP APQGISSLTSAVPRPRGKLAGLLRTFMRSRPSRQRLRQRGILRQRVFGCDLGEHLSNSGQDVPQVLRCCSEF IEAHGVVDGIYRLSGVSSNIQRLRHEFDSERIPELSGPAFLQDIHSVSSLCKLYFRELPNPLLTYQLYGKFSEA MSVPGEEERLVRV (SEQ ID NO: 1734) of T08446_PEA_1_P18 (SEQ ID NO:1370).

According to preferred embodiments of the present invention, there is provided an isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLILSALQARSTDSLDGPGEGSVQPLPTAGGPSVKGKPGKRLSAPRGPFPRLADCAHFH YENVDFGHIQLLLSPDREGPSLSGENELVFGVQVTCQGRSWPVLRSYDDFRSLDAHLHRCIFDRRFSCLPEL PPPPEGARAAQMLVPLLLQYLETLSGLVDSNLNCGPVLTWMELDNHGRRLLLSEEASLNIPAVAAAHVIK RYTAQAPDELSFEVGDIVSVIDMPPTEDRSWWRGKRGFQVGFFPSECVELFTERPGPGLKADADGPPCGIP APQGISSLTSAVPRPRGKLAGLLRTFMRSRPSRQRLRQRGILRQRVFGCDLGEHLSNSGQDVPQVLRCCSEF IEAHGVVDGIYRLSGVSSNIQRLRHEFDSERIPELSGPAFLQDIHSVSSLCKLYFRELPNPLLTYQLYGKFSEA MSVPGEEERLVRVHDVIQQLPPPHYRTLEYLLRHLARMARHSANTSMHARNLAIVWAPNLLRSMELESV GMGGAAAFREVRVQSVVVEFLLTHVDVLFSDTFTSAGLDPAGRCLLPRPKSLAGSCPSTRLLTLEEAQART QGRLGTPTEPTTPKAPASPAERRKGERGEKQRKPGGSSWKTFFALGRGPSVPRKKPLPWLGGTRAPPQPSG SRPDTVTLRSAKSEESLSSQASGAGLQRLHRLRRPHSSSDAFPVGPAPAGSCESLSSSSSSESSSSESSSSSES SAAGLGALSGSPSHRTSAWLDDGDELDFSPPRCLEGLRGLDFDPLTFRCSSPTPGDPAPPASPAPPAPASAF PPRVTPQAISPRGPTSPASPAALDISEPLAVSVPPAVLELLGAGGAPASATPTPALSPGRSLRPHLIPLLLRGA EAPLTDACQQEMCSKLRGAQGPLGPDMESPLPPPPLSLLRPGGAPPPPPKNPARLMALALAERAQQVAEQ QSQQECGGTPPASQSPFHRSLSLEVGGEPLGTSGSGPPPNSLAHPGAWVPGPPPYLPRQQSDGSLLRSQRPM GTSRRG corresponding to amino acids 1-1010 of T08446_PEA_1_P18 (SEQ ID NO:1370), and a second amino acid sequence being at least 90% homologous to LRGPAQVSAQLRAGGGGRDAPEAAAQSPCSVPSQVPTPGFFSPAPRECLPPFLGVPKPGLYPLGPPSFQPSS PAPVWRSSLGPPAPLDRGENLYYEIGASEGSPYSGPTRSWSPFRSMPPDRLNASYGMLGQSPPLHRSPDFLL SYPPAPSCFPPDHLGYSAPQHPARRPTPPEPLYVNLALGPRGPSPASSSSSPPAHPRSRSDPGPPVPRLPQKQ RAPWGPRTPHRVPGPWGPPEPLLLYRAAPPAYGRGGELHRGSLYRNGGQRGEGAGPPPPYPTPSWSLHSE GQTRSYC corresponding to amino acids 1-295 of Q96CP3 (SEQ ID NO:1444), which also corresponds to amino acids 1011-1305 of T08446_PEA_1_P18 (SEQ ID NO:1370), wherein said first amino acid sequence and second amino acid sequence are contiguous and in a sequential order.

According to preferred embodiments of the present invention, there is provided an isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTDSLDGPGEGSVQPLPTAGGPSVKGKPGKRLSAPRGPFPRLADCAHFH YENVDFGHIQLLLSPDREGPSLSGENELVFGVQVTCQGRSWPVLRSYDDFRSLDAHLHRCIFDRRFSCLPEL PPPPEGARAAQMLVPLLLQYLETLSGLVDSNLNCGPVLTWMELDNHG- RRLLLSEEASLNIPAVAAAHVIK RYTAQAPDELSFE-
VGDIVSVIDMPPTEDRSWWRGKRGFQVGFFPSECV-
ELFTERPGPGLKADADGPPCGIP APQGISSLT-
SAVPRPRGKLAGLLRTFMRSRPSkQRLRQRGILRQ-
RVFGCDLGEHLSNSGQDVPQVLRCCSEF IEAHGV-
VDGIYRLSGVSSNIQRLRHEFDSERIPELSGPAFL-
QDIHSVSSLCKLYFRELPNPLLTYQLYGKFSEA MSVP-
GEEERLVRVHDVIQQLPPPHYRTLEYLLRHLARMAR-
HSANTSMHARNLAIVWAPNLLRSMELESV GMG-
GAAAFREVRVQSVVVEFLLTHVDVLFSDTFTSAGL-
DPAGRCLLPRPKSLAGSCPSTRLLTLEEAQART QGR-
LGTPTEPTTPKAPASPAERRKGERGEKQRKPGG-
SSWKTFFALGRGPSVPRKKPLPWLGGTRAPPQPSG
SRPDTVTLRSAKSEESLSSQASGAGLQRLHRLRR-
PHSSSDAFPVGPAPAGSCESLSSSSSSESSSSESSSS-
SSES SAAGLGALSGSPSHRTSAWLDDGDELDF-
SPPRCLEGLRGLDFDPLTFRCSSPTPGDPAPPASPA-
PPAPASAF PPRVTPQAISPRGPTSPASPAALDIS-
EPLAVSVPPAVLELLGAGGAPASATPTPALSPGRSL-
PHLIPLLLRGA EAPLTDACQQEMCSKLRGAQGPLGP-
DMESPLPPPPLSLLRPGGAPPPPPKNPARLMALAL-
AEPAQQVAEQ QSQQECGGTPPASQSPF-
HRSLSLEVGGEPLGTSGSGPPPNSLAHPGAWVPGPP-
PYLPRQQSDGSLLRSQRPM GTSRRG of T08446_PEA_
1_P18 (SEQ ID NO:1370).

According to preferred embodiments of the present invention, there is provided an isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHL-WGPLILSALQARSTDSLDGPGEGSVQPLPTAGGPSV-KGKPGKRLSAPRGPFPRLADCAHFH YENVDF-GHIQLLLSPDREGPSLSGENELVFGVQVTCQGRS-WPVLRSYDDFRSLDAHLHRCIFDRRFSCLPEL PPPPE-GARAAQ corresponding to amino acids 1-154 of T08446_PEA_1_P18 (SEQ ID NO:1370), a second amino acid sequence being at least 90% homologous to MLV-PLLLQYLETLSGLVDSNLNCGPVLTWMELDNHGRR-LLLSEEASLNIPAVAAAHVIKRYTAQAPDELS FEVGDI-VSVIDMPPTEDRSWWRGKRGFQVGFFPSECVELFTE-RPGPGLKADADGPPCGIPAPQGISSLTSAV
PRPRGKLAGLLRTFMRSRPSRQRLRQRGILRQRVFG-CDLGEHLSNSGQDVPQVLRCCSEFIEAHGVVDGIY
RLSGVSSNIQRLRHEFDSERIPELSGPAFLQDIHSVS-SLCKLYFRELPNPLLTYQLYGKFSEAMSVPGEEERL
VRVHDVIQQLPPPHYRTLEYLLRHLARMARHSAN-TSMHARNLAIVWAPNLLRSMELESVGMGGAAAFRE
VRVQSVVVEFLLTHVDVLFSDTFTSAGLDPAGRCL-LPRPKSLAGSCPSTRLLTLEEAQARTQGRLGTPTEPT
TPKAPASPAERRKGERGEKQRKPGGSSWKTFFAL-GRGPSVPRKKPLPWLGGTRAPPQPSGSRPDTVTLRSA
KSEESLSSQASGAGLQRLHRLRRPHSSSDAFPVG-PAPAGSCESLSSSSSSESSSSESSSSSSESSAAGLGALSG
SPSHRTSAWLDDGDELDFSPPRCLEGLRGLDFDPL-TFRCSSPTPGDPAPPASPAPPAPASAFPPRVTPQAISP
RGPTSPASPAALDISEPLAVSVPPAVLELLGAGGA-PASATPTPALSPGRSLRPHLIPLLLRGAEAPLTDACQQ
EMCSKLRGAQGPLGPDMESPLPPPPLSLLRPGGAPPP-PPKNPARLMALALAERAQQVAEQQSQQEC-
GGTPP ASQSPFHRSLSLEVGGEPLGTSGSGPPP-NSLAHPGAWVPGPPPYLPRQQSDGSLLRSQRPMG-
TSRRGLRGP A corresponding to amino acids 1-861 of BAC86902 (SEQ ID NO:1445), which also corresponds to amino acids 155-1015 of T08446_PEA_1_P18 (SEQ ID NO:1370), a third amino acid sequence being at least 70%, optionally at least 80%, preferably at least 85%, more preferably at least 90% and most preferably at least 95% homologous to a polypeptide having the sequence QVSAQL-RAGGGGRDAPEAAAQSPCSVPS corresponding to amino acids 1016-1043 of T08446_PEA_1_P18 (SEQ ID NO:1370), a fourth amino acid sequence being at least 90% homologous to QVPTPGFFSPAPRECLPPFLGVPKPGLY-PLGPPSFQPSSPAPVWRSSLGPPAPLDRGENLYY-EIGASEGSPYS GPTRSWSPFRSMPPDRLNASYGM-LGQSPPLHRSPDFLLSYPPAPSCFPPDHLGYS corresponding to amino acids 862-989 of BAC86902 (SEQ ID NO:1445), which also corresponds to amino acids 1044-1171 of T08446_PEA_1_P18 (SEQ ID NO:1370), and a fifth amino acid sequence being at least 70%, optionally at least 80%, preferably at least 85%, more preferably at least 90% and most preferably at least 95% homologous to a polypeptide having the sequence APQHPARRPTPPEPLYVNLAL-GPRGPSPASSSSSSPPAHPRSRSDPGP-
PVPRLPQKQRAPWGPRTPHRVPGP
WGPPEPLLLYRAAPPAYGRGGEL-
HRGSLYRNGGQRGEGAGPPPPYPTPSWS-
LHSEGQTRSYC corresponding to amino acids 1172-1305 of T08446_PEA_1_P18 (SEQ ID NO:1370), wherein said first amino acid sequence, second amino acid sequence, third amino acid sequence, fourth amino acid sequence and fifth amino acid sequence are contiguous and in a sequential order.

According to preferred embodiments of the present invention, there is provided an isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLIL-SALQARSTDSLDGPGEGSVQPLPTAG-
GPSVKGKPGKRLSAPRGPFPRLADCAHFH
YENVDFGHIQLLLSPDREGPSLS-
GENELVFGVQVTCQGRSWPVLRSYD-
DFRSLDAHLHRCIFDRRFSCLPEL PPPPEGARAAQ of T08446_PEA_1_P18 (SEQ ID NO:1370).

According to preferred embodiments of the present invention, there is provided an isolated polypeptide encoding for an edge portion of T08446_PEA_1_P18 (SEQ ID NO:1370), comprising an amino acid sequence being at least 70%, optionally at least about 80%, preferably at least about 85%, more preferably at least about 90% and most preferably at least about 95% homologous to the sequence encoding for QVSAQLRAGGGGRDAPEAAAQSPCSVPS, corresponding to T08446_PEA_1_P18 (SEQ ID NO:1370).

According to preferred embodiments of the present invention, there is provided an isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence APQHPARRPTPPEPLYVNLALG-PRGPSPASSSSSSPPAHPRSRSDPGP-
PVPRLPQKQRAPWGPRTPHRVPGP
WGPPEPLLLYRAAPPAYGRGGEL-
HRGSLYRNGGQRGEGAGPPPPYPTPSWS-
LHSEGQTRSYC in T08446_PEA_1_P18 (SEQ ID NO:1370).

According to preferred embodiments of the present invention, there is provided an isolated chimeric polypeptide encoding for T11628_PEA_1_P2 (SEQ ID NO:1376), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPETLEKFDKFKHLKSEDE (SEQ ID NO:1735) corresponding to amino acids 1-55 of T11628_PEA_1_P2 (SEQ ID NO:1376), and a second amino acid sequence being at least 90% homologous to MKASEDLKKHGATVLTALGGILKKKGHHEAEIKPLAQSHATKHKIPVKYLEFISECIIQVLQSKHPGDFGA DAQGAMNKALELFRKDMASNYKELGFQG corresponding to amino acids 1-99 of Q8WVH6 (SEQ ID NO:1450), which also corresponds to amino acids 56-154 of T11628_PEA_1_P2 (SEQ ID NO:1376), wherein said first amino acid sequence and second amino acid sequence are contiguous and in a sequential order.

According to preferred embodiments of the present invention, there is provided an isolated polypeptide encoding for a head of T11628_PEA_1_P2 (SEQ ID NO:1376), comprising a polypeptide being at least 70%, optionally at least about 80%, preferably at least about 85%, more preferably at least about 90% and most preferably at least about 95% homologous to the sequence MGLSDGEWQLVLNVWGKVEADIPGHGQEVLIRLFKGHPETLEKFDKFKHLKSEDE (SEQ ID NO:1735) of T11628_PEA_1_P2 (SEQ ID NO:1376).

According to preferred embodiments of the present invention, there is provided an isolated chimeric polypeptide encoding for T11628_PEA_1_P5 (SEQ ID NO:1377), comprising a first amino acid sequence being at least 90% homologous to MKASEDLKKHGATVLTALGGILKKKGHHEAEIKPLAQSHATKHKIPVKYLEFISECIIQVLQSKHPGDFGA DAQGAMNKALELFRKDMASNYKELGFQG corresponding to amino acids 56-154 of MYG_HUMAN_V1 (SEQ ID NO:1449), which also corresponds to amino acids 1-99 of T11628_PEA_1_P5 (SEQ ID NO:1377).

According to preferred embodiments of the present invention, there is provided an isolated chimeric polypeptide encoding for T11628_PEA_1_P7 (SEQ ID NO:1378), comprising a first amino acid sequence being at least 90% homologous to MGLSDGEWQLVLNVWGKVEADIPGHGQEVLIRLFKGHPETLEKFDKFKHLKSEDEMKASEDLKKHGATV LTALGGILKKKGHHEAEIKPLAQSHATKHKIPVKYLEFISECIIQVLQSKHPGDFGADAQGAMNK corresponding to amino acids 1-134 of MYG_HUMAN_V1 (SEQ ID NO:1449), which also corresponds to amino acids 1-134 of T11628_PEA_1_P7 (SEQ ID NO:1378), and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA_1_P7 (SEQ ID NO:1378), wherein said first amino acid sequence and second amino acid sequence are contiguous and in a sequential order.

According to preferred embodiments of the present invention, there is provided an isolated chimeric polypeptide encoding for T11628_PEA_1_P10 (SEQ ID NO:1379), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPETLEKFDKFKHLKSEDE (SEQ ID NO:1735) corresponding to amino acids 1-55 of T11628_PEA_1_P10 (SEQ ID NO:1379), and a second amino acid sequence being at least 90% homologous to MKASEDLKKHGATVLTALGGILKKKGHHEAEIKPLAQSHATKHKIPVKYLEFISECIIQVLQSKHPGDFGA DAQGAMNKALELFRKDMASNYKELGFQG corresponding to amino acids 1-99 of Q8WVH6 (SEQ ID NO:1450), which also corresponds to amino acids 56-154 of T11628_PEA_1_P10 (SEQ ID NO:1379), wherein said first amino acid sequence and second amino acid sequence are contiguous and in a sequential order.

According to preferred embodiments of the present invention, there is provided an isolated polypeptide encoding for a head of T11628_PEA_1_P10 (SEQ ID NO:1379), comprising a polypeptide being at least 70%, optionally at least about 80%, preferably at least about 85%, more preferably at least about 90% and most preferably at least about 95% homologous to the sequence MGLSDGEWQLVLNVWGKVEADIPGHGQEVLIRLFKGHPETLEKFDKFKHLKSEDE (SEQ ID NO: 1735) of T11628_PEA_1_P10 (SEQ ID NO:1379).

According to preferred embodiments of the present invention, there is provided an isolated chimeric polypeptide encoding for R35137_PEA_1_PEA_1_PEA_1_P9 (SEQ ID NO:1385), comprising a first amino acid sequence being at least 90% homologous to MASSTGDRSQAVRHGLRAKVLTLDGMNPRVRRVEYAVRGPIVQRALELEQELRQGVKKPFTEVIRANIGD AQAMGQRPITFLRQVLALCVNPDLLSSPNFPDDAKKRAERILQACGGHSLGAYSVSSGIQLIREDVARYIER RDGGIPADPNNVFLSTGASDAIVTVLKLLVAGEGHTRTGVLIPIPQYPLYSATLAELGAVQVDYYLDEERA WALDVAELHRALGQARDHCRPRALCVINPGNPTGQVQTRECIEAVIRFAFEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P9 (SEQ ID NO:1385), and a second amino acid sequence being at least 70%, optionally at least 80%, preferably at least 85%, more preferably at least 90% and most preferably at least 95% homologous to a polypeptide having the sequence RGAGEREAGQQSAPVTPCALPGVPGQRVRRGFAVPLIQEGAHGDGAALRRAAGACLLPLHLQGLHGRVR AYEAGGGSRAMARPSSPDGPPPPPHLTWPCAGAGSAAAMWRW (SEQ ID NO: 1737) corresponding to amino acids 275-385 of R35137_PEA_1_PEA_1_PEA_1_P9 (SEQ ID NO:1385), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P9 (SEQ ID NO:1385), comprising a polypeptide being at least 70%, optionally at least about 80%, preferably at least about 85%, more preferably at least about 90% and most preferably at least about 95% homologous to the sequence RGAGEREAGQQSAPVTPCALPGVPGQRVRRGFAVPLIQEGAHGDGAALRRAAGACLLPLHLQGLHGRVR AYEAGGGSRAMARPSSPDGPPPPPHLTWPCAGAGSAAAMWRW (SEQ ID NO: 1737) in R35137_PEA_1_PEA_1_P9 (SEQ ID NO:1385).

According to preferred embodiments of the present invention, there is provided an isolated chimeric polypeptide encoding for R35137_PEA_1_PEA_1_PEA_1_P8 (SEQ ID NO:1386), comprising a first amino acid sequence being at least 90% homologous to MASSTGDRSQAVRHGLRAKVLTLDGMNPRVRRVEYAVRGPIVQRALELEQELRQGVKKPFTEVIRANIGD AQAMGQRPITFLRQVLALCVNPDLLSSPNFPDDAKKRAERILQACGGHSLGAYSVSSGIQLIREDVARYIER RDGGIPADPNNVFLSTGASDAIVTVLKLLVAGEGHTRTGVLIPIPQYPLYSATL- AELGAVQVDYYLDEERA WALDVAELHRAL-GQARDHCRPRALCVINPGNPTGQVQTRE-CIEAVIRFAFEERLFLLADEVYQDNVYAAG SQFHS-FKKVLMEMGPPYAGQQELASFHSTSKGYMGEC corresponding to amino acids 1-320 of ALAT_HUMAN_V1 (SEQ ID NO:1453), which also corresponds to amino acids 1-320 of R35137_PEA_1_PEA_1_PEA_1_P8 (SEQ ID NO:1386), and a second amino acid sequence being at least 70%, optionally at least 80%, preferably at least 85%, more preferably at least 90% and most preferably at least 95% homologous to a polypeptide having the sequence VRTRRV-GARGPWPGPPRPMGHPLLRT (SEQ ID NO: 1738) corresponding to amino acids 321-346 of R35137_PEA_1_PEA_1_PEA_1_P8 (SEQ ID NO:1386), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P8 (SEQ ID NO:1386), comprising a polypeptide being at least 70%, optionally at least about 80%, preferably at least about 85%, more preferably at least about 90% and most preferably at least about 95% homologous to the sequence VRTRRV-GARGPWPGPPRPMGHPLLRT (SEQ ID NO: 1738) in R35137_PEA_1_PEA_1_PEA_1_P8 (SEQ ID NO:1386).

According to preferred embodiments of the present invention, there is provided an isolated chimeric polypeptide encoding for R35137_PEA_1_PEA_1_PEA_1_P11 (SEQ ID NO:1387), comprising a first amino acid sequence being at least 90% homologous to MASSTGDRSQAVRHGLRAKV-LTLDGMNPRVRRVEYAVRGPIV-QRALELEQELRQGVKKPFTEVIRANIGD AQAMGQRPITFLRQVLALCVNPDLLSSP-NFPDDAKKRAERILQACGGHSL-GAYSVSSGIQLIREDVARYIER RDGGIPADPNNVFLST-GASDAIVTVLKLLVAGEGHTRTGVLIPIPQYPLYSATL-AELGAVQVDYYLDEERA WALDVAELHRALGQAR corresponding to amino acids 1-229 of ALAT_HUMAN_V1 (SEQ ID NO:1453), which also corresponds to amino acids 1-229 of R35137_PEA_1_PEA_1_PEA_1_P11 (SEQ ID NO:1387), and a second amino acid sequence being at least 90% homologous to SGFGQREGTYHFRMTILPPLEKLR-LLLEKLSRFHAKFTLEYS corresponding to amino acids 455-496 of ALAT_HUMAN_V1 (SEQ ID NO:1453), which also corresponds to amino acids 230-271 of R35137_PEA_1_PEA_1_PEA_1_P11 (SEQ ID NO:1387), wherein said first amino acid sequence and second amino acid sequence are contiguous and in a sequential order.

According to preferred embodiments of the present invention, there is provided an isolated chimeric polypeptide encoding for an edge portion of R35137_PEA_1_PEA_1_PEA_1_P11 (SEQ ID NO:1387), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RS, having a structure as follows: a sequence starting from any of amino acid numbers 229-x to 229; and ending at any of amino acid numbers 230+((n−2)−x), in which x varies from 0 to n−2.

According to preferred embodiments of the present invention, there is provided an isolated chimeric polypeptide encoding for R35137_PEA_1_PEA_1_PEA_1_P2 (SEQ ID NO:1388), comprising a first amino acid sequence being at least 90% homologous to MASSTGDRSQAVRHGLRAKV-LTLDGMNPRVRRVEYAVRGPIV-QRALELEQELRQGVKKPFTEVIRANIGD AQAMGQRPITFLRQVLALCVNPDLLSSP-NFPDDAKKRAERILQACGGHSL-GAYSVSSGIQLIREDVARYIER RDGGIPADPNNVFLST-GASDAIVTVLKLLVAGEGHTRTGVLIPIPQYPLYSATL-AELGAVQVDYYLDEERA WALDVAELHRAL-GQARDHCRPRALCVINPGNPTGQVQTRE-CIEAVIRFAFEERLFLLADEV corresponding to amino acids 1-274 of ALAT_HUMAN_V1 (SEQ ID NO:1453), which also corresponds to amino acids 1-274 of R35137_PEA_1_PEA_1_PEA_1_P2 (SEQ ID NO:1388), and a second amino acid sequence being at least 70%, optionally at least 80%, preferably at least 85%, more preferably at least 90% and most preferably at least 95% homologous to a polypeptide having the sequence RGAGEREAGQQSAPVT-PCALPGVPGQRVRRGFAVPLIQEGAHGD-GAALRRAAGACLLPLHLQGLHGRVR VPRRLCGGGE-HGRCSAAADAEADECAAVPAGARTGPAGPGGQPAR-AHRPLLCAVPG (SEQ ID NO: 1739) corresponding to amino acids 275-399 of R35137_PEA_1_PEA_1_PEA_1_P2 (SEQ ID NO:1388), wherein said first amino acid sequence and second amino acid sequence are contiguous and in a sequential order.

According to preferred embodiments of the present invention, there is provided an isolated polypeptide encoding for a tail of R35137_PEA_1_PEA_1_PEA_1_P2 (SEQ ID NO:1388), comprising a polypeptide being at least 70%, optionally at least about 80%, preferably at least about 85%, more preferably at least about 90% and most preferably at least about 95% homologous to the sequence RGAGEREAGQQSAPVTP-CALPGVPGQRVRRGFAVPLIQEGAHGD-GAALRRAAGACLLPLHLQGLHGRVR VPRRLCGGGE-HGRCSAAADAEADECAAVPAGARTGPAGPGGQPAR-AHRPLLCAVPG (SEQ ID NO: 1739) in R35137_PEA_1_PEA_1_PEA_1_P2 (SEQ ID NO:1388).

According to preferred embodiments of the present invention, there is provided an isolated chimeric polypeptide encoding for R35137_PEA_1_PEA_1_PEA_1_P4 (SEQ ID NO:1389), comprising a first amino acid sequence being at least 90% homologous to MASSTGDRSQAVRHGLRAKV-LTLDGMNPRVRRVEYAVRGPIV-QRALELEQELRQGVKKPFTEVIRANIGD AQAMGQRPITFLRQVLALCVNPDLLSSP-NFPDDAKKRAERILQACGGHSL-GAYSVSSGIQLIREDVARYIER RDGGIPADPNNVFLST-GASDAIVTVLKLLVAGEGHTRTGVLIPIPQYPLYSATL-AELGAVQVDYYLDEERA WALDVAELHRAL-GQARDHCRPRALCVINPGNPTGQVQTRE-CIEAVIRFAFEERLFLLADEVYQDNVYAAG SQFHS-FKKVLMEMGPPYAGQQELASFHSTSKGYMGECGFR-GGYVEVVNMDAAVQQQMLKLMSVRLCPP VPGQALLDLVVSPPAPTDPS-FAQFQAEKQAVLAELAAKAKLTEQVFNE-APGISCNPVQGAMYSFPRVQLP PRAVERAQELGLAP-DMFFCLRLLEETGICVVPGSGFGQREGTYHFRMTILP-PLEKLRLLLEKLSRFHAKFTL E corresponding to amino acids 1-494 of ALAT_HUMAN_V1 (SEQ ID NO:1453), which also corresponds to amino acids 1-494 of R35137_PEA_1_PEA_1_PEA_1_P4 (SEQ ID NO:1389), and a second amino acid sequence being at least 70%, optionally at least 80%, preferably at least 85%, more preferably at least 90% and most preferably at least 95% homologous to a polypeptide having the sequence SPGRLWSPLYLLLMPG-GVGWGGCWAPASLQVPNKAVWQSD-SKKEALAAAWPAPTCLPFLQA (SEQ ID NO: 1740) corresponding to amino acids 495-555 of R35137_PEA_

1_PEA__1_PEA__1_P4 (SEQ ID NO:1389), wherein said first amino acid sequence and second amino acid sequence are contiguous and in a sequential order.

According to preferred embodiments of the present invention, there is provided an isolated polypeptide encoding for a tail of R35137_PEA__1_PEA__1_PEA__1_P4 (SEQ ID NO:1389), comprising a polypeptide being at least 70%, optionally at least about 80%, preferably at least about 85%, more preferably at least about 90% and most preferably at least about 95% homologous to the sequence SPGRLWSPLYLLLMPGGVGWGGCWAPASLQVP-NKAVWQSDSKKEALAAAWPAPTCLPFLQA (SEQ ID NO: 1740) in R35137_PEA__1_PEA__1_PEA__1_P4 (SEQ ID NO:1389).

According to preferred embodiments of the present invention, there is provided an isolated chimeric polypeptide encoding for R11723_PEA__1_P6 (SEQ ID NO:1410), comprising a first amino acid sequence being at least 70%, optionally at least 80%, preferably at least 85%, more preferably at least 90% and most preferably at least 95% homologous to a polypeptide having the sequence MWVLGIAATFCGLFLLPGFALQIQCYQCEEFQLNNDCSSPEFIVNCTVNVQDMCQKEVMEQSAGIMYRKS CASSAACLIASAGSPCRGLAPGRE-EQRALHKAGAVGGGVR (SEQ ID NO: 1741) corresponding to amino acids 1-110 of R11723_PEA__1_P6 (SEQ ID NO:1410), and a second amino acid sequence being at least 90% homologous to MYAQALLVVGVLQRQAAAQHL-HEHPPKLLRGHRVQERVDDRAEVEKRL-REGEEDHVRPEVGPRPVVLG FGRSHDPPNLVGH-PAYGQCHNNQPWADTSRRERQRKEKHSMRTQ corresponding to amino acids 1-112 of Q8IXM0 (SEQ ID NO:1707), which also corresponds to amino acids 111-222 of R11723_PEA__1_P6 (SEQ ID NO:1410), wherein said first and second amino acid sequences are contiguous and in a sequential order.

According to preferred embodiments of the present invention, there is provided an isolated polypeptide encoding for a head of R11723_PEA__1_P6 (SEQ ID NO:1410), comprising a polypeptide being at least 70%, optionally at least about 80%, preferably at least about 85%, more preferably at least about 90% and most preferably at least about 95% homologous to the sequence MWVLGIAATFCGLFLLPGFALQIQ-CYQCEEFQLNNDCSSPEFIVNCTVNVQD-MCQKEVMEQSAGIMYRKS CASSAACLIASAGSPCRGLAPGRE-EQRALHKAGAVGGGVR (SEQ ID NO: 1741) of R11723_PEA__1_P6 (SEQ ID NO:1410).

According to preferred embodiments of the present invention, there is provided an isolated chimeric polypeptide encoding for R11723_PEA__1_P6 (SEQ ID NO:1410), comprising a first amino acid sequence being at least 90% homologous to MWVLGIAATFCGLFLLPGFALQIQCYQ-CEEFQLNNDCSSPEFIVNCTVNVQDMC-QKEVMEQSAGIMYRKS CASSAACLIASAG corresponding to amino acids 1-83 of Q96AC2 (SEQ ID NO:1708), which also corresponds to amino acids 1-83 of R11723_PEA__1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRGHRVQERVDD RAEVEKRLREGEEDHVRPEVGPRPVVLG-FGRSHDPPNLVGHPAYGQCHNNQP-WADTSRRERQRKEKHSM RTQ (SEQ ID NO: 1742) corresponding to amino acids 84-222 of R11723_PEA__1_P6 (SEQ ID NO:1410), wherein said first and second amino acid sequences are contiguous and in a sequential order.

According to preferred embodiments of the present invention, there is provided an isolated polypeptide encoding for a tail of R11723_PEA__1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRGHRVQERVDD RAEVEKRLREGEEDHVRPEVGPRPVVLG-FGRSHDPPNLVGHPAYGQCHNNQP-WADTSRRERQRKEKHSM RTQ (SEQ ID NO: 1742) in R11723_PEA__1_P6 (SEQ ID NO:1410).

According to preferred embodiments of the present invention, there is provided an isolated chimeric polypeptide encoding for R11723_PEA__1_P6 (SEQ ID NO:1410), comprising a first amino acid sequence being at least 90% homologous to MWVLGIAATFCGLFLLPGFALQIQCYQ-CEEFQLNNDCSSPEFIVNCTVNVQDMC-QKEVMEQSAGIMYRKS CASSAACLIASAG corresponding to amino acids 1-83 of Q8N2G4 (SEQ ID NO:1709), which also corresponds to amino acids 1-83 of R11723_PEA__1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRGHRVQERVDD RAEVEKRLREGEEDHVRPEVGPRPVVLG-FGRSHDPPNLVGHPAYGQCHNNQP-WADTSRRERQRKEKHSM RTQ (SEQ ID NO: 1742) corresponding to amino acids 84-222 of R11723_PEA__1_P6 (SEQ ID NO:1410), wherein said first and second amino acid sequences are contiguous and in a sequential order.

According to preferred embodiments of the present invention, there is provided an isolated polypeptide encoding for a tail of R11723_PEA__1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-HEHPPKLLRGHRVQERVDD RAEVEKRLREGEEDHVRPEVGPRPVVLG-FGRSHDPPNLVGHPAYGQCHNNQP-WADTSRRERQRKEKHSM RTQ (SEQ ID NO: 1742) in R11723_PEA__1_P6 (SEQ ID NO:1410).

According to preferred embodiments of the present invention, there is provided an isolated chimeric polypeptide encoding for R11723_PEA__1_P6 (SEQ ID NO:1410), comprising a first amino acid sequence being at least 90% homologous to MWVLGIAATFCGLFLLPGFALQIQCYQ-CEEFQLNNDCSSPEFIVNCTVNVQDMC-QKEVMEQSAGIMYRKS CASSAACLIASAG corresponding to amino acids 24-106 of BAC85518 (SEQ ID NO:1710), which also corresponds to amino acids 1-83 of R11723_PEA__1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGA-VGGGVRMYAQALLVVGVLQRQAAAQHL-HEHPPKLLRGHRVQERVDD RAEVEKRLREGEEDHVRPEVGPRPVVLG-
FGRSHDPPNLVGHPAYGQCHNNQP-
WADTSRRERQRKEKHSM RTQ (SEQ ID NO: 1742) corresponding to amino acids 84-222 of R11723_PEA_1_P6 (SEQ ID NO:1410), wherein said first and second amino acid sequences are contiguous and in a sequential order.

According to preferred embodiments of the present invention, there is provided an isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHL-
HEHPPKLLRGHRVQERVDD
RAEVEKRLREGEEDHVRPEVGPRPVVLG-
FGRSHDPPNLVGHPAYGQCHNNQP-
WADTSRRERQRKEKHSM RTQ (SEQ ID NO: 1742) in R11723_PEA_1_P6 (SEQ ID NO:1410).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMC-
QKEVMEQSAG corresponding to amino acids 1-64 of Q96AC2 (SEQ ID NO:1708), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO: 1743) corresponding to amino acids 65-93 of R1723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMC-
QKEVMEQSAG corresponding to amino acids 1-64 of Q8N2G4 (SEQ ID NO:1709), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO: 1743) corresponding to amino acids 65-93 of R11723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 70%, optionally at least 80%, preferably at least 85%, more preferably at least 90% and most preferably at least 95% homologous to a polypeptide having the sequence MWVLG (SEQ ID NO: 1744) corresponding to amino acids 1-5 of R11723_PEA_1_P7 (SEQ ID NO:1411), second amino acid sequence being at least 90% homologous to IAATFCGLFLLPGFALQIQ-CYQCEEFQLNNDCSSPEFIVNCTVNVQD-
MCQKEVMEQSAG corresponding to amino acids 22-80 of BAC85273, which also corresponds to amino acids 6-64 of R11723_PEA_1_P7 (SEQ ID NO:1411), and a third amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO: 1743) corresponding to amino acids 65-93 of R11723_PEA_1_P7 (SEQ ID NO:1411), wherein said first, second and third amino acid sequences are contiguous and in a sequential order.

According to preferred embodiments of the present invention, there is provided an isolated polypeptide encoding for a head of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P7 (SEQ ID NO:1411).

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 1743) in R11723_PEA_1_P7 (SEQ ID NO:1411).

According to preferred embodiments of the present invention, there is provided an isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMC-
QKEVMEQSAG corresponding to amino acids 24-87 of BAC85518 (SEQ ID NO:1710), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO: 1743) corresponding to amino acids 65-93 of R11723_PEA_1_P7 (SEQ ID NO:1411), wherein said first and second amino acid sequences are contiguous and in a sequential order.

According to preferred embodiments of the present invention, there is provided an isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO:1743) in R11723_PEA_1_P7 (SEQ ID NO:1411).

According to preferred embodiments of the present invention, there is provided an isolated chimeric polypeptide encoding for R11723_PEA_1_P13 (SEQ ID NO:1412), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q96AC2 (SEQ ID NO:1708), which also corresponds to amino acids 1-63 of R11723_PEA_1_P13 (SEQ ID NO:1412), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO: 1745) corresponding to amino acids 64-84 of R11723_PEA_1_P13 (SEQ ID NO:1412), wherein said first and second amino acid sequences are contiguous and in a sequential order.

According to preferred embodiments of the present invention, there is provided an isolated polypeptide encoding for a tail of R11723_PEA_1_P13 (SEQ ID NO:1412), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO: 1745) in R11723_PEA_1_P13 (SEQ ID NO:1412).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q96AC2 (SEQ ID NO:1708), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO:1746) in R11723_PEA_1_P 0 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q8N2G4 (SEQ ID NO:1709), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1746) in R11723_PEA_1_P10 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 70%, optionally at least 80%, preferably at least 85%, more preferably at least 90% and most preferably at least 95% homologous to a polypeptide having the sequence MWVLG (SEQ ID NO: 1744) corresponding to amino acids 1-5 of R11723_PEA_1_P10 (SEQ ID NO:1413), second amino acid sequence being at least 90% homologous to IAAT-FCGLFLLPGFALQIQCYQCEEFQLNNDC-SSPEFIVNCTVNVQDMCQKEVMEQSA corresponding to amino acids 22-79 of BAC85273, which also corresponds to amino acids 6-63 of R11723_PEA_1_P10 (SEQ ID NO:1413), and a third amino acid sequence being at least 70%, optionally at least 80%, preferably at least 85%, more preferably at least 90% and most preferably at least 95% homologous to a polypeptide having the sequence DRVS-LCHEAGVQWNNFSTLQPLPPRLK (SEQ ID NO: 1746) corresponding to amino acids 64-90 of R11723_PEA_1_P10 (SEQ ID NO:1413), wherein said first, second and third amino acid sequences are contiguous and in a sequential order.

According to preferred embodiments of the present invention, there is provided an isolated polypeptide encoding for a head of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence MWVLG (SEQ ID NO: 1744) of R11723_PEA_1_P10 (SEQ ID NO:1413).

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 1746) in R11723_PEA_1_P10 (SEQ ID NO:1413).

According to preferred embodiments of the present invention, there is provided an isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 24-86 of BAC85518 (SEQ ID NO:1710), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ- PLPPRLK (SEQ ID NO: 1746) corresponding to amino acids 64-90 of R11723_PEA_1_P10 (SEQ ID NO:1413), wherein said first and second amino acid sequences are contiguous and in a sequential order.

According to preferred embodiments of the present invention, there is provided an isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1746) in R11723_PEA_1_P10 (SEQ ID NO:1413).

According to preferred embodiments of the present invention, there is provided an isolated chimeric polypeptide encoding for R16276_PEA_1_P7 (SEQ ID NO:1414), comprising a first amino acid sequence being at least 90% homologous to MQSVQSTSFCLRKQCLCLTFLLLHLLGQVAATQRCPPQCPG corresponding to amino acids 1-41 of NOV_HUMAN (SEQ ID NO:1463), which also corresponds to amino acids 1-41 of R16276_PEA_1_P7 (SEQ ID NO:1414), a bridging amino acid Q corresponding to amino acid 42 of R16276_PEA_1_P7 (SEQ ID NO:1414), a second amino acid sequence being at least 90% homologous to CPATPPTCAPGVRAVLDGCSCCLVCARQRGESCSDLEPCDESSGLYCDRSADPSNQTGICT corresponding to amino acids 43-103 of NOV_HUMAN (SEQ ID NO:1463), which also corresponds to amino acids 43-103 of R16276_PEA_1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO:1748) corresponding to amino acids 104-111 of R16276_PEA_1_P7 (SEQ ID NO:1414), wherein said first amino acid sequence, bridging amino acid, second amino acid sequence and third amino acid sequence are contiguous and in a sequential order.

According to preferred embodiments of the present invention, there is provided an isolated polypeptide encoding for a tail of R16276_PEA_1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO: 1748) in R16276_PEA_1_P7 (SEQ ID NO:1414).

According to preferred embodiments of the present invention, there is provided an isolated chimeric polypeptide encoding for R16276_PEA_1_P7 (SEQ ID NO:1414), comprising a first amino acid sequence being at least 90% homologous to MQSVQSTSFCLRKQCLCLTFLLLHLLGQVAATQRCPPQCPG corresponding to amino acids 1-41 of NOV_HUMAN (SEQ ID NO:1463), which also corresponds to amino acids 1-41 of R16276_PEA_1_P7 (SEQ ID NO:1414), a bridging amino acid Q corresponding to amino acid 42 of R16276_PEA_1_P7 (SEQ ID NO:1414), a second amino acid sequence being at least 90% homologous to CPATPPTCAPGVRAVLDGCSCCLVCARQRGESCSDLEPCDESSGLYCDRSADPSNQTGICT corresponding to amino acids 43-103 of NOV_HUMAN (SEQ ID NO:1463), which also corresponds to amino acids 43-103 of R16276_PEA_1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO: 1748) corresponding to amino acids 104-111 of R16276_PEA_1_P7 (SEQ ID NO:1414), wherein said first amino acid sequence, bridging amino acid, second amino acid sequence and third amino acid sequence are contiguous and in a sequential order.

According to preferred embodiments of the present invention, there is provided an isolated polypeptide encoding for a tail of R16276_PEA_1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO: 1748) in R16276_PEA_1_P7 (SEQ ID NO:1414).

According to preferred embodiments of the present invention, there is provided an isolated chimeric polypeptide encoding for HUMCEA_PEA_1_P4 (SEQ ID NO:1380), comprising a first amino acid sequence being at least 90% homologous to MESPSAPPHRWCIPWQRLLLTASLLTFWNPPTTAKLTIESTPFNVAEGKEVLLLVHNLPQHLFGYSWYKGE RVDGNRQIIGYVIGTQQATPGPAYSGREIIYPNASLLIQNIIQNDTGFYTLHVIKSDLVNEEATGQFRVYPEL PKPSISSNNSKPVEDKDAVAFTCEPETQDATYLWWVNNQSLPVSPRLQLSNGNRTLTLFNVTRNDTASYK CETQNPVSARRSDSVILNVL corresponding to amino acids 1-234 of CEA5_HUMAN (SEQ ID NO:1451), which also corresponds to amino acids 1-234 of HUMCEA_PEA_1_P4 (SEQ ID NO:1380), and a second amino acid sequence being at least 70%, optionally at least 80%, preferably at least 85%, more preferably at least 90% and most preferably at least 95% homologous to a polypeptide having the sequence CEYICSSLAQAASPNPQGQRQDFSVPLRFKYTDPQPWTSRLSVTFCPRKTWADQVLTKNRRGGAASVLGG SGSTPYDGRNR (SEQ ID NO:1749) corresponding to amino acids 235-315 of HUMCEA_PEA_1_P4 (SEQ ID NO:1380), wherein said first amino acid sequence and second amino acid sequence are contiguous and in a sequential order.

According to preferred embodiments of the present invention, there is provided an isolated polypeptide encoding for a tail of HUMCEA_PEA_1_P4 (SEQ ID NO:1380), comprising a polypeptide being at least 70%, optionally at least about 80%, preferably at least about 85%, more preferably at least about 90% and most preferably at least about 95% homologous to the sequence CEYICSSLAQAASPNPQGQRQDFSVPLRFKYTDPQPWTSRLSVTFCPRKTWADQVLTKNRRGGAASVLGG SGSTPYDGRNR (SEQ ID NO:1749) in HUMCEA_PEA_1_P4 (SEQ ID NO:1380).

According to preferred embodiments of the present invention, there is provided an isolated chimeric polypeptide encoding for HUMCEA_PEA_1_P5 (SEQ ID NO:1381), comprising a first amino acid sequence being at least 90% homologous to MESPSAPPHRWCIPWQRLLLTASLLTFWNPPTTAKLTIESTPFNVAEGKEVLLLVHNLPQHLFGYSWYKGE RVDGNRQIIGYVIGTQQATPGPAYSGREIIYPNASLLIQNIIQNDTGFYTLHVIKSDLVNEEATGQFRVYPEL PKPSISSNNSKPVEDKDAVAFTCEPETQDATYLWWVNNQSLPVSPRLQLSNGNRTLTLFNVTRNDTASYK CETQNPVSARRSDSVILNVLYGPDAPTISPLNTSYRSGENLNLSCHAASNPPAQYSWFVNGTFQQSTQELFI PNITVNNSGSYTCQAHNSDTGLNRTTVTTITVYAEPPKPFITSNNSNPVEDEDAVALTCEPEIQNTFYLWW VNNQSLPVSPRLQLSNDNRTLTLLSVTRNDVGPYECGIQNELSVDHSDPVILNVLYGPDDPTISPSYTYYRP GVNLSLSCHAASNPPAQYSWLIDGNIQQHTQELFISNITEKNSGLYTCQANNSASGHSRTTVKTITVSAELP KPSISSNNSKPVEDKDAVAFTCE- PEAQNTTYLWWVNGQSLPVSPRLQLSNG-NRTLTLFNVTRNDARAYVC GIQNSVSANRSDPVTLD-VLYGPDTPIISPPDSSYLSGANLNLSCHSASNPSPQYS-WRINGIPQQHTQVLFIAKI TPNNNGTYACFVSNLAT-GRNNSIVKSITVS corresponding to amino acids 1-675 of CEA5_HUMAN (SEQ ID NO:1451), which also corresponds to amino acids 1-675 of HUMCEA_PEA_1_P5 (SEQ ID NO:1381), and a second amino acid sequence being at least 70%, optionally at least 80%, preferably at least 85%, more preferably at least 90% and most preferably at least 95% homologous to a polypeptide having the sequence GKWLP-GASASYSGVESIWFSPKSQEDIFF-PSLCSMGTRKSQILS (SEQ ID NO: 1750) corresponding to amino acids 676-719 of HUMCEA_PEA_1_P5 (SEQ ID NO:1381), wherein said first amino acid sequence and second amino acid sequence are contiguous and in a sequential order.

According to preferred embodiments of the present invention, there is provided an isolated polypeptide encoding for a tail of HUMCEA_PEA_1_P5 (SEQ ID NO:1381), comprising a polypeptide being at least 70%, optionally at least about 80%, preferably at least about 85%, more preferably at least about 90% and most preferably at least about 95% homologous to the sequence GKWLPGASASYSGVESIWFSPK-SQEDIFFPSLCSMGTRKSQILS (SEQ ID NO: 1750) in HUMCEA_PEA_1_P5 (SEQ ID NO:1381).

According to preferred embodiments of the present invention, there is provided an isolated chimeric polypeptide encoding for HUMCEA_PEA_1_P19 (SEQ ID NO:1383), comprising a first amino acid sequence being at least 90% homologous to MESPSAPPHRWCIPWQRLLLTASLLTF-WNPPTTAKLTIESTPFNVAEGKEV-LLLVHNLPQHLFGYSWYKGE RVDGNRQII-GYVIGTQQATPGPAYSGREIIYPNASLLIQNIIQNDTGF-YTLHVIKSDLVNEEATGQFRVYPEL PKPSISSNNSK-PVEDKDAVAFTCEPETQDATYLWWVN-NQSLPVSPRLQLSNGNRTLTLFNVTRNDTASYK CETQNPVSARRSDSVILN corresponding to amino acids 1-232 of CEA5_HUMAN (SEQ ID NO:1451), which also corresponds to amino acids 1-232 of HUMCEA_PEA_1_P19 (SEQ ID NO:1383), and a second amino acid sequence being at least 90% homologous to VLYGPDTPIISPPDS-SYLSGANLNLSCHSASNPSPQYSWRING-IPQQHTQVLFIAKITPNNNGTYACFVSNLA TGRNNSIVKSITVSASGTSPGLSA-GATVGIMIGVLVGVALI corresponding to amino acids 589-702 of CEA5_HUMAN (SEQ ID NO:1451), which also corresponds to amino acids 233-346 of HUMCEA_PEA_1_P19 (SEQ ID NO:1383), wherein said first amino acid sequence and second amino acid sequence are contiguous and in a sequential order.

According to preferred embodiments of the present invention, there is provided an isolated chimeric polypeptide encoding for an edge portion of HUMCEA_PEA_1_P19 (SEQ ID NO:1383), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NV, having a structure as follows: a sequence starting from any of amino acid numbers 232-x to 232; and ending at any of amino acid numbers 233+((n−2)−x), in which x varies from 0 to n−2.

According to preferred embodiments of the present invention, there is provided an isolated chimeric polypeptide encoding for HUMCEA_PEA_1_P20 (SEQ ID NO:1384), comprising a first amino acid sequence being at least 90% homologous to MESPSAPPHRWCIPWQRLLLTASLLTF-WNPPTTAKLTIESTPFNVAEGKEVLLLVHNLPQHL-FGYSWYKGE RVDGNRQIIGYVIGTQQATPGPAY-SGREIIYPNASLLIQNIIQNDTGFYTLH-VIKSDLVNEEATGQFRVYP corresponding to amino acids 1-142 of CEA5_HUMAN (SEQ ID NO:1451), which also corresponds to amino acids 1-142 of HUMCEA_PEA_1_P20 (SEQ ID NO:1384), and a second amino acid sequence being at least 90% homologous to ELPKPSISSNNSKPVED-KDAVAFTCEPEAQNTTYLWWVNGQS-LPVSPRLQLSNGNRTLTLFNVTRNDARA YVCGIQNS-VSANRSDPVTLDVLYGPDTPIISPPDSSYLSGANLNLS-CHSASNPSPQYSWRINGIPQQHTQVLF IAKITP-NNNGTYACFVSNLATGRNNSIVK-SITVSASGTSPGLSAGATVGIMIGVLVGVALI corresponding to amino acids 499-702 of CEA5_HUMAN (SEQ ID NO:1451), which also corresponds to amino acids 143-346 of HUMCEA_PEA_1_P20 (SEQ ID NO:1384), wherein said first amino acid sequence and second amino acid sequence are contiguous and in a sequential order.

According to preferred embodiments of the present invention, there is provided an isolated chimeric polypeptide encoding for an edge portion of HUMCEA_PEA_1_P20 (SEQ ID NO:1384), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PE, having a structure as follows: a sequence starting from any of amino acid numbers 142-x to 142; and ending at any of amino acid numbers 143+((n−2)−x), in which x varies from 0 to n−2.

According to preferred embodiments of the present invention, there is provided an isolated chimeric polypeptide encoding for Z44808_PEA_1_P5 (SEQ ID NO:1314), comprising a first amino acid sequence being at least 90% homologous to MLLPQLCWLPLLAGLLPPVPAQKF-SALTFLRVDQDKDKDCSLDCAGSPQKPL-CASDGRTFLSRCEFQRAK CKDPQLEIAYRGNCKDVS-RCVAERKYTQEQARKEFQQVFIPECNDDGTYSQVQ-CHSYTGYCWCVTPNGR PISGTAVAHKTPRCPGS-VNEKLPYGREGTGKTDDAAA-PALETQPQGDEEDIASRYPTLWTEQVKSRQNKTN KNSVSSCDQEHQSALEEAKQPKNDNVVI-PECAHGGLYKPVQCHPSTGYCWCVLVDT-GRPIPGTSTRYEQP KCDNTARAHPAKARD-LYKGRQLQGCPGAKKHEFLTSVLDALSTDMVHAAS-DPSSSSGRLSEPDPSHTLEE RVVHWYFKLLDKNSSG-DIGKKEIKPFKRFLRKKSKP-KKCVKKFVEYCDVNNDKSISVQELMGCLGVAKE DGKADTKKRHTPRGHAESTSNRQ corresponding to amino acids 1-441 of SMO2_HUMAN (SEQ ID NO:1430), which also corresponds to amino acids 1-441 of Z44808_PEA_1_P5 (SEQ ID NO:1314), and a second amino acid sequence being at least 70%, optionally at least 80%, preferably at least 85%, more preferably at least 90% and most preferably at least 95% homologous to a polypeptide having the sequence DAMVVSSRPKATTHRK-SRTLSRR (SEQ ID NO: 1751) corresponding to amino acids 442-464 of Z44808_PEA_1_P5 (SEQ ID NO:1314), wherein said first and second amino acid sequences are contiguous and in a sequential order.

According to preferred embodiments of the present invention, there is provided an isolated polypeptide encoding for a tail of Z44808_PEA_1_P5 (SEQ ID NO:1314), comprising a polypeptide being at least 70%, optionally at least about 80%, preferably at least about 85%, more preferably at least about 90% and most preferably at least about 95% homologous to the sequence DAMWSSRPKATTHRKSRTLSRR (SEQ ID NO: 1751) in Z44808_PEA_1_P5 (SEQ ID NO:1314).

According to preferred embodiments of the present invention, there is provided an isolated chimeric polypeptide encoding for Z44808_PEA_1_P6 (SEQ ID NO:1315), comprising a first amino acid sequence being at least 90% homologous to MLLPQLCWLPLLAGLLPPVPAQKF-SALTFLRVDQDKDKDCSLDCAGSPQKPL-CASDGRTFLSRCEFQRAK CKDPQLEIAYRGNCKDVS-RCVAERKYTQEQARKEFQQVFIPECNDDGTYSQVQC-HSYTGYCWCVTPNGR PISGTAVAHKTPRCPGSVNEK-LPQREGTGKTDDAAAPALETQPQGDEEDIASR-YPTLWTEQVKSRQNKTN KNSVSSCDQEHQSALEE-AKQPKNDNVVIPECAHGGLYKPVQCHP-STGYCWCVLVDTGRPIPGTSTRYEQP KCDNTARAH-PAKARDLYKGRQLQGCPGAKKHEFLTSVLDALSTD-MVHAASDPSSSSGRLSEPDPSHTLEE RVVHWYFKLL-DKNSSGDIGKKEIKPFKRFLRKKSKPKKCVKK-FVEYCDVNNDKSISVQELMGCLGVAKE DGKADT-KKRH corresponding to amino acids 1-428 of SMO2_HUMAN (SEQ ID NO:1430), which also corresponds to amino acids 1-428 of Z44808_PEA_1_P6 (SEQ ID NO:1315), and a second amino acid sequence being at least 70%, optionally at least 80%, preferably at least 85%, more preferably at least 90% and most preferably at least 95% homologous to a polypeptide having the sequence RSKRNL (SEQ ID NO:1752) corresponding to amino acids 429-434 of Z44808_PEA_1_P6 (SEQ ID NO:1315), wherein said first and second amino acid sequences are contiguous and in a sequential order.

According to preferred embodiments of the present invention, there is provided an isolated polypeptide encoding for a tail of Z44808_PEA_1_1_P6 (SEQ ID NO:1315), comprising a polypeptide being at least 70%, optionally at least about 80%, preferably at least about 85%, more preferably at least about 90% and most preferably at least about 95% homologous to the sequence RSKRNL (SEQ ID NO: 1752) in Z44808_PEA_1_P6 (SEQ ID NO:1315).

According to preferred embodiments of the present invention, there is provided an isolated chimeric polypeptide encoding for Z44808_PEA_1_P7 (SEQ ID NO:1316), comprising a first amino acid sequence being at least 90% homologous to MLLPQLCWLPLLAGLLPPVPAQKF-SALTFLRVDQDKDKDCSLDCAGSPQKPL-CASDGRTFLSRCEFQRAK CKDPQLEIAYRGNCKDVS-RCVAERKYTQEQARKEFQQVFIPECNDDGTYSQVQ-CHSYTGYCWCVTPNGR PISGTAVAHKTPRCPGS-VNEKLPQREGTGKTDDAAAPALETQPQGDEEDIAS-RYPTLWTEQVKSRQNKTN KNSVSSCDQEHQSALEE-AKQPKNDNVVIPECAHGGLYKPVQCHP-STGYCWCVLVDTGRPIPGTSTRYEQP KCDNTARAH-PAKARDLYKGRQLQGCPGAKKHEFLTSVLDALSTD-MVHAASDPSSSSGRLSEPDPSHTLEE RVVHWYFKLL-DKNSSGDIGKKEIKPFKRFLRKKSKP-KKCVKKFVEYCDVNNDKSISVQELMGCLGVAKE DGKADTKKRHTPRGHAESTSNRQ corresponding to amino acids 1-441 of SMO2_HUMAN (SEQ ID NO:1430), which also corresponds to amino acids 1-441 of Z44808_PEA_1_P7 (SEQ ID NO:1316), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO: 1753) corresponding to amino acids 442-454 of Z44808_PEA_1_P7 (SEQ ID NO:1316), wherein said first and second amino acid sequences are contiguous and in a sequential order.

According to preferred embodiments of the present invention, there is provided an isolated polypeptide encoding for a tail of Z44808_PEA_1_P7 (SEQ ID NO:1316), comprising a polypeptide being at least 70%, optionally at least about 80%, preferably at least about 85%, more preferably at least about 90% and most preferably at least about 95% homologous to the sequence LLWLRGKVSFYCF (SEQ ID NO: 1753) in Z44808_PEA_1_P7 (SEQ ID NO:1316).

According to preferred embodiments of the present invention, there is provided an isolated chimeric polypeptide encoding for Z44808_PEA_1_P1 (SEQ ID NO:1317), comprising a first amino acid sequence being at least 90% homologous to MLLPQLCWLPLLAGLLPPVPAQKF-SALTFLRVDQDKDKDCSLDCAGSPQKPL-CASDGRTFLSRCEFQRAK CKDPQLEIAYRGNCKDVS-RCVAERKYTQEQARKEFQQVFIPECNDDGTYSQVQ-CHSYTGYCWCVTPNGR PISGTAVAHKTPRCPGS-VNEKLPQREGTGKT corresponding to amino acids 1-170 of SMO2_HUMAN (SEQ ID NO:1430), which also corresponds to amino acids 1-170 of Z44808_PEA_1_P11 (SEQ ID NO:1317), and a second amino acid sequence being at least 90% homologous to DIASRYPTLWTEQVKSRQNK-TNKNSVSSCDQEHQSALEEAKQPKNDNV-VIPECAHGGLYKPVQCHPSTGY CWCVLVDT-GRPIPGTSTRYEQPKCDNTARAHPAKARDLYKGRQL-QGCPGAKKHEFLTSVLDALSTDMVH AASDPSSSS-GRLSEPDPSHTLEERVVHWYFKLLDKNS-SGDIGKKEIKPFKRFLRKKSKPKKCVKKFVEYCD VNNDKSISVQELMGCLGVAKEDGKADT-KKRHTPRGHAESTSNRQPRKQG corresponding to amino acids 188-446 of SMO2_HUMAN (SEQ ID NO:1430), which also corresponds to amino acids 171-429 of Z44808_PEA_1_P11 (SEQ ID NO:1317), wherein said first and second amino acid sequences are contiguous and in a sequential order.

According to preferred embodiments of the present invention, there is provided an isolated chimeric polypeptide encoding for an edge portion of Z44808_PEA_1_P11 (SEQ ID NO:1317), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170-x to −170; and ending at any of amino acid numbers 171+((n−2)−x), in which x varies from 0 to n−2.

According to preferred embodiments of the present invention, there is provided an isolated chimeric polypeptide encoding for H61775_P16 (SEQ ID NO:1281), comprising a first amino acid sequence being at least 90% homologous to MVWCLGLAVLSLVISQGADGRGKPEVVS-VVGRAGESVVLGCDLLPPAGRPPLH-VIEWLRFGFLLPIFIQFG LYSPRIDPDYVG corresponding to amino acids 11-93 of Q9P2J2 (SEQ ID NO:1694), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGF-PAFRELKRAETVSPVFFTRRCIWEDLKSTGFSPAGG-GRPPGGGPRTQEDSGLPCWRSSCSVTLQV (SEQ ID NO:1754) corresponding to amino acids 84-152 of H61775_P16 (SEQ ID NO:1281), wherein said first and second amino acid sequences are contiguous and in a sequential order.

According to preferred embodiments of the present invention, there is provided an isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIWEDLKSTGFSPAGGGRPPGGGPRTQEDSGLPCWRSSCSVTLQV (SEQ ID NO: 1754) in H61775_P16 (SEQ ID NO:1281).

According to preferred embodiments of the present invention, there is provided an isolated chimeric polypeptide encoding for H61775_P16 (SEQ ID NO:1281), comprising a first amino acid sequence being at least 90% homologous to MVWCLGLAVLSLVISQGADGRGKPEVVSVVGRAGESVVLGCDLLPPAGRPPLHVIEWLRFGFLLPIFIQFG LYSPRIDPDYVG corresponding to amino acids 1-83 of AAQ88495 (SEQ ID NO:1695), which also corresponds to amino acids 1-83 of H61775_P16 (SEQ ID NO:1281), and a second amino acid sequence being at least 70%, optionally at least 80%, preferably at least 85%, more preferably at least 90% and preferably at least 95% homologous to a polypeptide having the sequence DCGFPAFRELKRAETVSPVFFTRRCIWEDLKSTGFSPAGGGRPPGGGPRTQEDSGLPCWRSSCSVTLQV (SEQ ID NO:1754) corresponding to amino acids 84-152 of H61775_P16 (SEQ ID NO:1281), wherein said first and second amino acid sequences are contiguous and in a sequential order.

According to preferred embodiments of the present invention, there is provided an isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIWEDLKSTGFSPAGGGRPPGGGPRTQEDSGLPCWRSSCSVTLQV (SEQ ID NO: 1754) in H61775_P16 (SEQ ID NO:1281).

According to preferred embodiments of the present invention, there is provided an isolated chimeric polypeptide encoding for H61775_P17 (SEQ ID NO:1282), comprising a first amino acid sequence being at least 90% homologous to MVWCLGLAVLSLVISQGADGRGKPEVVSVVGRAGESVVLGCDLLPPAGRPPLHVIEWLRFGFLLPIFIQFG LYSPRIDPDYVG corresponding to amino acids 11-93 of Q9P2J2 (SEQ ID NO:1694), which also corresponds to amino acids 1-83 of H61775_P17 (SEQ ID NO:1282).

According to preferred embodiments of the present invention, there is provided an isolated chimeric polypeptide encoding for H61775_P17 (SEQ ID NO:1282), comprising a first amino acid sequence being at least 90% homologous to MVWCLGLAVLSLVISQGADGRGKPEVVSVVGRAGESVVLGCDLLPPAGRPPLHVIEWLRFGFLLPIFIQFG LYSPRIDPDYVG corresponding to amino acids 1-83 of AAQ88495 (SEQ ID NO:1695), which also corresponds to amino acids 1-83 of H61775_P17 (SEQ ID NO:1282).

According to preferred embodiments of the present invention, there is provided an isolated chimeric polypeptide encoding for M85491_PEA_1_P13 (SEQ ID NO:1283), comprising a first amino acid sequence being at least 90% homologous to MALRRLGAALLLLPLLAAVEETLMDSTTATAELGWMVHPPSGWEEVSGYDENMNTIRTYQVCNVFESSQ NNWLRTKFIRRRGAHRIHVEMKFSVRDCSSIPSVPGSCKETFNLYYYEADFDSATKTFPNWMENPWVKVD TIAADESFSQVDLGGRVMKINTEVRSFGPVSRSGFYLAFQDYGGCMSLIAVRVFYRKCPRIIQNGAIFQETL SGAESTSLVAARGSCIANAEEVDVPIKLYCNGDGEWLVPIGRCMCKAGFEAVENGTVCRGCPSGTFKANQ GDEACTHCPINSRTTSEGATNCVCRNGYYRADLDPLDMPCTTIPSAPQAVISSVNETSLMLEWTPPRDSGG REDLVYNIICKSCGSGRGACTRCGDNVQYAPRQLGLTEPRIYISDLLAHTQYTFEIQAVNGVTDQSPFSPQF ASVNITTNQAAPSAVSIMHQVSRTVDSITLSWSQPDQPNGVILDYELQYYEK corresponding to amino acids 1-476 of EPB2_HUMAN (SEQ ID NO:1417), which also corresponds to amino acids 1-476 of M85491_PEA_1_P13 (SEQ ID NO:1283), and a second amino acid sequence being at least 70%, optionally at least 80%, preferably at least 85%, more preferably at least 90% and most preferably at least 95% homologous to a polypeptide having the sequence VPIGWVLSPSPTSLRAPLPG (SEQ ID NO: 1755) corresponding to amino acids 477-496 of M85491_PEA_1_P13 (SEQ ID NO:1283), wherein said first and second amino acid sequences are contiguous and in a sequential order.

According to preferred embodiments of the present invention, there is provided an isolated polypeptide encoding for a tail of M85491_PEA_1_P13 (SEQ ID NO:1283), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO: 1755) in M85491_PEA_1_P13 (SEQ ID NO:1283).

According to preferred embodiments of the present invention, there is provided an isolated chimeric polypeptide encoding for M85491_PEA_1_P14 (SEQ ID NO:1284), comprising a first amino acid sequence being at least 90% homologous to MALRRLGAALLLLPLLAAVEETLMDSTTATAELGWMVHPPSGWEEVSGYDENMNTIRTYQVCNVFESSQ NNWLRTKFIRRRGAHRIHVEMKFSVRDCSSIPSVPGSCKETFNLYYYEADFDSATKTFPNWMENPWVKVD TIAADESFSQVDLGGRVMKINTEVRSFGPVSRSGFYLAFQDYGG CMSLIAVRVFYRKCPRIIQNGAIFQETL SGAESTSLVAARGSCIANAEEVDVPIKLYCNGDGEWLVPIGRCMCKAGFEAVENGTVCR corresponding to amino acids 1-270 of EPB2_HUMAN (SEQ ID NO:1417), which also corresponds to amino acids 1-270 of M85491_PEA_1_P14 (SEQ ID NO:1284), and a second amino acid sequence being at least 70%, optionally at least 80%, preferably at least 85%, more preferably at least 90% and most preferably at least 95% homologous to a polypeptide having the sequence ERQDLTMLSRLVLNSWPQMILPPQPPKVLEL (SEQ ID NO:1756) corresponding to amino acids 271-301 of M85491_PEA_1_P14 (SEQ ID NO:1284), wherein said first and second amino acid sequences are contiguous and in a sequential order.

According to preferred embodiments of the present invention, there is provided an isolated polypeptide encoding for a tail of M85491_PEA_1_P14 (SEQ ID NO:1284), comprising a polypeptide being at least 70%, optionally at least about 80%, preferably at least about 85%, more preferably at least about 90% and most preferably at least about 95% homologous to the sequence ERQDLTMLSRLVLNSWPQMILPPQPPKVLEL (SEQ ID NO:1756) in M85491_PEA_1_P14 (SEQ ID NO:1284).

According to preferred embodiments of the present invention, there is provided an isolated chimeric polypeptide encoding for T39971_P6 (SEQ ID NO:1285), comprising a first amino acid sequence being at least 90% homologous to MAPLRPLLILALLAWVALADQESCKGRCTEGFNVD-KKCQCDELCSYYQSCCTDYTAECKPQVTRGDVFT MPEDEYTVYDDGEEKNNATVHEQVGGPSLTSDLQ-AQSKGNPEQTPVLKPEEEAPAPEVGASKPEGIDSRP ETLHPGRPQPPAEEELCSGKPFDAFTDLKNGSLFA-FRGQYCYELDEKAVRPGYPKLIRDVWGIEGPIDAAFT RINCQGKTYLFKGSQYWRFEDGVLDPDYPRNISD-GFDGIPDNVDAALALPAHSYSGRERVYFFKG corresponding to amino acids 1-276 of VTNC_HUMAN (SEQ ID NO:1418), which also corresponds to amino acids 1-276 of T39971_P6 (SEQ ID NO:1285), and a second amino acid sequence being at least 70%, optionally at least 80%, preferably at least 85%, more preferably at least 90% and most preferably at least 95% homologous to a polypeptide having the sequence TQGVVGD (SEQ ID NO:1757) corresponding to amino acids 277-283 of T39971P6 (SEQ ID NO:1285), wherein said first and second amino acid sequences are contiguous and in a sequential order.

According to preferred embodiments of the present invention, there is provided an isolated polypeptide encoding for a tail of T39971_P6 (SEQ ID NO:1285), comprising a polypeptide being at least 70%, optionally at least about 80%, preferably at least about 85%, more preferably at least about 90% and most preferably at least about 95% homologous to the sequence TQGVVGD (SEQ ID NO: 1757) in T39971_P6 (SEQ ID NO:1285).

According to preferred embodiments of the present invention, there is provided an isolated chimeric polypeptide encoding for T39971_P9 (SEQ ID NO:1286), comprising a first amino acid sequence being at least 90% homologous to MAPLRPLLILALLAWVALADQESCKGRCTEGFNV-DKKCQCDELCSYYQSCCTDYTAECKPQVTRGDVFT MPEDEYTVYDDGEEKNNATVHEQVGGPSLTSDLQA-QSKGNPEQTPVLKPEEEAPAPEVGASKPEGIDSRP ETLHPGRPQPPAEEELCSGKPFDAFTDLKNGSLFAF-RGQYCYELDEKAVRPGYPKLIRDVWGIEGPIDAAFT RINCQGKTYLFKGSQYWRFEDGVLDPDYPRNIS-DGFDGIPDNVDAALALPAHSYSGRERVYFFKGKQ-YWE YQFQHQPSQEECEGSSLSAVFEHFAMM-QRDSWEDIFELLFWGRT corresponding to amino acids 1-325 of VTNC_HUMAN (SEQ ID NO:1418), which also corresponds to amino acids 1-325 of T39971_P9 (SEQ ID NO:1286), and a second amino acid sequence being at least 90% homologous to SGMAPRPSLAKKQRFRHRN-RKGYRSQRGHSRGRNQNSRRPSRATWLSLFSSEES-LGANNYDDYRMDW LVPATCEPIQSVFFFSGD-KYYRVNLRTRRVDTVDPPYPRSIAQYWLGCPAPGHL corresponding to amino acids 357-478 of VTNC_HUMAN (SEQ ID NO:1418), which also corresponds to amino acids 326-447 of T39971_P9 (SEQ ID NO:1286), wherein said first and second amino acid sequences are contiguous and in a sequential order.

According to preferred embodiments of the present invention, there is provided an isolated chimeric polypeptide encoding for an edge portion of T39971_P9 (SEQ ID NO:1286), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325-x to 325; and ending at any of amino acid numbers 326+((n−2)−x), in which x varies from 0 to n−2.

According to preferred embodiments of the present invention, there is provided an isolated chimeric polypeptide encoding for T39971_P11 (SEQ ID NO:1287), comprising a first amino acid sequence being at least 90% homologous to MAPLRPLLILALLAWVALADQESCK-GRCTEGFNVDKKCQCDELCSYYQSCCTDYTAECK-PQVTRGDVFT MPEDEYTVYDDGEEKNNATVHEQV-GGPSLTSDLQAQSKGNPEQTPVLKPEEEAPAPEVG-ASKPEGIDSRP ETLHPGRPQPPAEEELCSGKPFDAFT-DLKNGSLFAFRGQYCYELDEKAVRPGYPKLIRDV-WGIEGPIDAAFT RINCQGKTYLFKGSQYWRFEDGV-LDPDYPRNISDGFDGIPDNVDAALALPAHSYSGRERV-YFFKGKQYWE YQFQHQPSQEECEGSSLSAVFEH-FAMMQRDSWEDIFELLFWGRTS corresponding to amino acids 1-326 of VTNC_HUMAN (SEQ ID NO:1418), which also corresponds to amino acids 1-326 of T39971_P11 (SEQ ID NO:1287), and a second amino acid sequence being at least 90% homologous to DKYYRVNLRTRRVDTVDP-PYPRSIAQYWLGCPAPGHL corresponding to amino acids 442-478 of VTNC_HUMAN (SEQ ID NO:1418), which also corresponds to amino acids 327-363 of T39971_P111 (SEQ ID NO:1287), wherein said first and second amino acid sequences are contiguous and in a sequential order.

According to preferred embodiments of the present invention, there is provided an isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)−x), in which x varies from 0 to n−2.

According to preferred embodiments of the present invention, there is provided an isolated chimeric polypeptide encoding for T39971_P11 (SEQ ID NO:1287), comprising a first amino acid sequence being at least 90% homologous to MAPLRPLLILALLAWVALADQESCKGRCTEGFNVD-KKCQCDELCSYYQSCCTDYTAECKPQVTRGDVFT MPEDEYTVYDDGEEKNNATVHEQVGGPSLTSDL-QAQSKGNPEQTPVLKPEEEAPAPEVGASKPEGIDSRP ETLHPGRPQPPAEEELCSGKPFDAFTDLKNGSLFA-FRGQYCYELDEKAVRPGYPKLIRDVWGIEGPIDAAFT RINCQGKTYLFKGSQYWRFEDGVLDPDYPRNISDGF-DGIPDNVDAALALPAHSYSGRERVYFFKGKQYWE YQFQHQPSQEECEGSSLSAVFEHFAMMQRDSWED-IFELLFWGRTS corresponding to amino acids 1-326 of Q9BSH7, which also corresponds to amino acids 1-326 of T39971_P11 (SEQ ID NO:1287), and a second amino acid sequence being at least 90% homologous to DKYYRVNLR-TRRVDTVDPPYPRSIAQYWLGCPAPGHL corresponding to amino acids 442-478 of Q9BSH7, which also corresponds to amino acids 327-363 of T39971_P11 (SEQ ID NO:1287), wherein said first and second amino acid sequences are contiguous and in a sequential order.

According to preferred embodiments of the present invention, there is provided an isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)−x), in which x varies from 0 to n−2.

According to preferred embodiments of the present invention, there is provided an isolated chimeric polypeptide encoding for T39971_P12 (SEQ ID NO:1288), comprising a first amino acid sequence being at least 90% homologous to MAPLRPLLILALLAWVALADQESCKGRCTEGFNVD-KKCQCDELCSYYQSCCTDYTAECKPQVTRGDVFT MPEDEYTVYDDGEEKNNATVHEQVGGPSLTSDLQA-QSKGNPEQTPVLKPEEEAPAPEVGASKPEGIDSRP ETLHPGRPQPPAEEELCSGKPFDAFTDLKNGSLFAFR-GQYCYELDEKAVRPGYPKLIRDVWGIEGPIDAAFT RINCQGKTYLFK corresponding to amino acids 1-223 of VTNC_HUMAN (SEQ ID NO:1418), which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1758) corresponding to amino acids 224-238 of T39971_P12 (SEQ ID NO:1288), wherein said first and second amino acid sequences are contiguous and in a sequential order.

According to preferred embodiments of the present invention, there is provided an isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO: 1758) in T39971_P12 (SEQ ID NO:1288).

According to preferred embodiments of the present invention, there is provided an isolated chimeric polypeptide encoding for T39971_P12 (SEQ ID NO:1288), comprising a first amino acid sequence being at least 90% homologous to MAPLRPLLILALLAWVALADQESCKGRCTEGFNVD-KKCQCDELCSYYQSCCTDYTAECKPQVTRGDVFT MPEDEYTVYDDGEEKNNATVHEQVGGPSLTSDLQ-AQSKGNPEQTPVLKPEEEAPAPEVGASKPEGIDSRP ETLHPGRPQPPAEEELCSGKPFDAFTDLKNGSLFA-FRGQYCYELDEKAVRPGYPKLIRDVWGIEGPIDAAFT RINCQGKTYLFK corresponding to amino acids 1-223 of Q9BSH7, which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1758) corresponding to amino acids 224-238 of T39971_P12 (SEQ ID NO:1288), wherein said first and second amino acid sequences are contiguous and in a sequential order.

According to preferred embodiments of the present invention, there is provided an isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

According to preferred embodiments of the present invention, there is provided an isolated chimeric polypeptide encoding for Z21368_PEA_1_P2 (SEQ ID NO:1289), comprising a first amino acid sequence being at least 90% homologous to MKYSCCALVLAVLGTELLGSLCSTVR-SPRFRGRIQQERKNIRPNIILVLTDDQDVELGSLQ-VMNKTRKIME HGGATFINAFVTTPMCCPSRSSMLT-GKYVHNHNVYTNNENCSSPSWQAMHEPRTFAVYL-NNTGYRTAFF GKYLNEYNGSYIPPGWREWLGLIKN-SRFYNYTVCRNGIKEKHGFDYAKDYFTDLITNESI-NYFKMSKRMY PHRPVMMVISHAAPHGPEDSAPQF-SKLYPNASQHITPSYNYAPNMDKHWIMQYTGPM-LPIHMEFTNILQR KRLQTLMSVDDSVERLYNMLVET-GELENTYIIYTADHGYHIGQFGLVKGKSMPYDF-DIRVPFFIRGPSVEP GSIVPQIVLNIDLAPTILDIA-GLDTPPDVDGKSVLKLLDPEKPGNRFRTNKKAKI-WRDTFLVERGKFLRKKE ESSKNIQQSNHLPKY-ERVKELCQQARYQTACEQPGQKWQCIEDTSGKLRI-HKCKGPSDLLTVRQSTRNLY ARGFHDKDKEC-SCRESGYRASRSQRKSQRQFLRNQGTPKYKPRF-VHTRQTRSLSVEFEGEIYDINLEEEEE LQVLQPR-NIAKRHDEGHKGPRDLQASSGGNRGRMLADSSNA-VGPPTTVRVTHKCFILPNDSIHCERELYQS ARAWKDHKAYIDKEIEALQDKIKNLREVRGHLK-RRKPEECSCSKQSYYNKEKGVKKQEKLKSHLHPFKE AAQEVDSKLQLFKENNRRRKKERKEKRRQRKGE-ECSLPGLTCFTHDNNHWQTAPFWN corresponding to amino acids 1-761 of SUL1_HUMAN (SEQ ID NO:1419), which also corresponds to amino acids 1-761 of Z21368_PEA_1_P2 (SEQ ID NO:1289), and a second amino acid sequence being at least 70%, optionally at least 80%, preferably at least 85%, more preferably at least 90% and most preferably at least 95% homologous to a polypeptide having the sequence PHKYSAHGRTRHFESATRTT-NGAQKLSRI (SEQ ID NO:1759) corresponding to amino acids 762-790 of Z21368_PEA_1_P2 (SEQ ID NO:1289), wherein said first and second amino acid sequences are contiguous and in a sequential order.

According to preferred embodiments of the present invention, there is provided an isolated polypeptide encoding for a tail of Z21368_PEA_1_P2 (SEQ ID NO:1289), comprising a polypeptide being at least 70%, optionally at least about 80%, preferably at least about 85%, more preferably at least about 90% and most preferably at least about 95% homologous to the sequence PHKYSAHGRTRHFESATRTT-NGAQKLSR1 (SEQ ID NO: 1759) in Z21368_PEA_1_P2 (SEQ ID NO:1289).

According to preferred embodiments of the present invention, there is provided an isolated chimeric polypeptide encoding for Z21368_PEA_1_P5 (SEQ ID NO:1290), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of Q7Z2W2 (SEQ ID NO:1697), which also corresponds to amino acids 1-57 of Z21368_PEA_1_P5 (SEQ ID NO:1290), second bridging amino acid sequence comprising A, and a third amino acid sequence being at least 90% homologous to FFGKYLNEY-NGSYIPPGWREWLGLIKNSRFYNY-TVCRNGIKEKHGFDYAKDYFTDLITNESINYFKMSKR MYPHRPVMMVISHAAPHGPEDSAPQF-SKLYPNASQHITPSYNYAPNMDKHWIM-QYTGPMLPIHMEFTNIL QRKRLQTLMSVDDSVER-LYNMLVETGELENTYIIYTADHGYHIGQFGLVKGKS-MPYDFDIRVPFFIRGPSV EPGSIVPQIVLNIDLAPTIL-DIAGLDTPPDVDGKSVLKLLDPEKPGNRFRTNKK-AKIWRDTFLVERGKFLRK KEESSKNIQQSNHLPKY-ERVKELCQQARYQTACEQPGQKWQCIEDTSGK-LRIHKCKGPSDLLTVRQSTRN LYARGFHDKDKEC-SCRESGYRASRSQRKSQRQFLRNQGTPKYKPRFV-HTRQTRSLSVEFEGEIYDINLEEE EELQVLQPR-NIAKRHDEGHKGPRDLQASSGGNRGRMLADSSNA-VGPPTTVRVTHKCFILPNDSIHCERELY QSARAWKD- HKAYIDKEIEALQDKIKNLREVRGHLKRRKPEECSCSKQSYYNKEKGVKKQEKLKSHLHPF KEAAQEVDSKLQLFKENNRRRKKERKEKRRQRKGEECSLPGLTCFTHDNNHWQTAPFWNLGSFCACTSS NNNTYWCLRTVNETHNFLFCEFATGFLEYFDMNTDPYQLTNTVHTVERGILNQLHVQLMELRSCQGYKQ CNPRPKNLDVGNKDGGSYDLHRGQLWDGWEG corresponding to amino acids 139-871 of Q7Z2W2 (SEQ ID NO:1697), which also corresponds to amino acids 59-791 of Z21368_PEA_1_P5 (SEQ ID NO:1290), wherein said first, second and third amino acid sequences are contiguous and in a sequential order.

According to preferred embodiments of the present invention, there is provided an isolated polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LAF having a structure as follows (numbering according to Z21368_PEA_1_P5 (SEQ ID NO:1290)): a sequence starting from any of amino acid numbers 57-x to 57; and ending at any of amino acid numbers 59+((n−2)−x), in which x varies from 0 to n−2.

According to preferred embodiments of the present invention, there is provided an isolated chimeric polypeptide encoding for Z21368_PEA_1_P5 (SEQ ID NO:1290), comprising a first amino acid sequence being at least 70%, optionally at least 80%, preferably at least 85%, more preferably at least 90% and most preferably at least 95% homologous to a polypeptide having the sequence MKYSCCALVLAVLGTELLGSLCSTVRSPRFRGRIQQERKNIRPNIILVLTDDQDVELAFFGKYLNEYNGSYI PPGWREWLGLIKNSRFYNYTVCRNGIKEKHGFDYAKDYFTDLITNESINYFKMSKRMYPHRPVMMVISHA APHGPEDSAPQFSKLYPNASQHITPSYNYAPNMDKHWIMQYTGPMLPIHMEFTNILQRKRLQTLMSVDDS VERLYNMLVETGELENTYIIYTADHGYHIGQFGLVKGKSMPYDFDIRVPFFIRGPSVEPGSIVPQIVLNIDLA PTILDIAGLDTPPDVDGKSVLKLLDPEKPGNRFRTNKKAKIWRDTFLVERGKFLRKKEESSKNIQQSNHLPK YERVKELCQQARYQTACEQPGQKWQCIEDTSGKLRIHKCKGPSDLLTVRQSTRNLYARGFHDKDKECSC RESGYRASRSQRKSQRQFLRNQGTPKYKPRFVHTRQTRSLSVEFEGEIYDINLEEEELQVLQPRNIAKRHD EGHKGPRDLQASSGGNRGRMLADSSNAVGPPTTVRVTHKCFILPNDSIHCERELYQSARAWKDHKAYIDK EIEALQDKIKNLREVRGHLKRRKPEECSCSKQSYYNKEKGVKKQEKLKSHLHPFKEAAQEVDSKLQLFKE NNRRRKKERKEKRRQRKGEECSLPGLTCFTHDNNHWQTAPFWNLGSFCACTSSNNNTYWCLRTVNETH NFLFCEFATGFLEYFDMNTDPYQLTNTVHTVERGILNQLHVQLME (SEQ ID NO: 1760) corresponding to amino acids 1-751 of Z21368_PEA_1_P5 (SEQ ID NO:1290), and a second amino acid sequence being at least 90% homologous to LRSCQGYKQCNPRPKNLDVGNKDGGSYDLHRGQLWDGWEG corresponding to amino acids 1-40 of AAH12997 (SEQ ID NO:1698), which also corresponds to amino acids 752-791 of Z21368_PEA_1_P5 (SEQ ID NO:1290), wherein said first and second amino acid sequences are contiguous and in a sequential order.

According to preferred embodiments of the present invention, there is provided an isolated polypeptide encoding for a head of Z21368_PEA_1_P5 (SEQ ID NO:1290), comprising a polypeptide being at least 70%, optionally at least about 80%, preferably at least about 85%, more preferably at least about 90% and most preferably at least about 95% homologous to the sequence MKYSCCALVLAVLGTELLGSLCSTVRSPRFRGRIQQERKNIRPNIILVLTDDQDVELAFFGKYLNEYNGSYI PPGWREWLGLIKNSRFYNYTVCRNGIKEKHGFDYAKDYFTDLITNESINYFKMSKRMYPHRPVMMVISHA APHGPEDSAPQFSKLYPNASQHITPSYNYAPNMDKHWIMQYTGPMLPIHMEFTNILQRKRLQTLMSVDDS VERLYNMLVETGELENTYIIYTADHGYHIGQFGLVKGKSMPYDFDIRVPFFIRGPSVEPGSIVPQIVLNIDLA PTILDIAGLDTPPDVDGKSVLKLLDPEKPGNRFRTNKKAKIWRDTFLVERGKFLRKKEESSKNIQQSNHLPK YERVKELCQQARYQTACEQPGQKWQCIEDTSGKLRIHKCKGPSDLLTVRQSTRNLYARGFHDKDKECSC RESGYRASRSQRKSQRQFLRNQGTPKYKPRFVHTRQTRSLSVEFEGEIYDINLEEEELQVLQPRNIAKRHD EGHKGPRDLQASSGGNRGRMLADSSNAVGPPTTVRVTHKCFILPNDSIHCERELYQSARAWKDHKAYIDK EIEALQDKIKNLREVRGHLKRRKPEECSCSKQSYYNKEKGVKKQEKLKSHLHPFKEAAQEVDSKLQLFKE NNRRRKKERKEKRRQRKGEECSLPGLTCFTHDNNHWQTAPFWNLGSFCACTSSNNNTYWCLRTVNETH NFLFCEFATGFLEYFDMNTDPYQLTNTVHTVERGILNQLHVQLME (SEQ ID NO:1760) of Z21368_PEA_1_P5 (SEQ ID NO:1290).

According to preferred embodiments of the present invention, there is provided an isolated chimeric polypeptide encoding for Z21368_PEA_1_P5 (SEQ ID NO:1290), comprising a first amino acid sequence being at least 90% homologous to MKYSCCALVLAVLGTELLGSLCSTVRSPRFRGRIQQERKNIRPNIILVLTDDQDVEL corresponding to amino acids 1-57 of SUL1_HUMAN (SEQ ID NO:1419), which also corresponds to amino acids 1-57 of Z21368_PEA_1_P5 (SEQ ID NO:1290), and a second amino acid sequence being at least 90% homologous to AFFGKYLNEYNGSYIPPGWREWLGLIKNSRFYNYTVCRNGIKEKHGFDYAKDYFTDLITNESINYFKMSKR MYPHRPVMMVISHAAPHGPEDSAPQFSKLYPNASQHITPSYNYAPNMDKHWIMQYTGPMLPIHMEFTNIL QRKRLQTLMSVDDSVERLYNMLVETGELENTYIIYTADHGYHIGQFGLVKGKSMPYDFDIRVPFFIRGPSV EPGSIVPQIVLNIDLAPTILDIAGLDTPPDVDGKSVLKLLDPEKPGNRFRTNKKAKIWRDTFLVERGKFLRK KEESSKNIQQSNHLPKYERVKELCQQARYQTACEQPGQKWQCIEDTSGKLRIHKCKGPSDLLTVRQSTRN LYARGFHDKDKECSCRESGYRASRSQRKSQRQFLRNQGTPKYKPRFVHTRQTRSLSVEFEGEIYDINLEEE ELQVLQPRNIAKRHDEGHKGPRDLQASSGGNRGRMLADSSNAVGPPTTVRVTHKCFILPNDSIHCERELY QSARAWKDHKAYIDKEIEALQDKIKNLREVRGHLKRRKPEECSCSKQSYYNKEKGVKKQEKLKSHLHPF KEAAQEVDSKLQLFKENNRRRKKERKEKRRQRKGEECSLPGLTCFTHDNNHWQTAPFWNLGSFCACTSS NNNTYWCLRTVNETHNFLFCEFATGFLEYFDMNTDPYQLTNTVHTVERGILNQLHVQLMELRSCQGYKQ CNPRPKNLDVGNKDGGSYDLHRGQLWDGWEG corresponding to amino acids 138-871 of SUL1_HUMAN (SEQ ID NO:1419), which also corresponds to amino acids 58-791 of Z21368_PEA_1_P5 (SEQ ID NO:1290), wherein said first and second amino acid sequences are contiguous and in a sequential order.

According to preferred embodiments of the present invention, there is provided an isolated chimeric polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57-x to 57; and ending at any of amino acid numbers 58+((n−2)−x), in which x varies from 0 to n−2.

According to preferred embodiments of the present invention, there is provided an isolated chimeric polypeptide encoding for Z21368_PEA_1_P15 (SEQ ID NO:1291), comprising a first amino acid sequence being at least 90% homologous to MKYSCCALVLAVLGTELLGSLCSTVRSPRFRGRIQQERKNIRPNIILVLTDDQDVELGSLQVMNKTRKIME HGGATFINAFVTTPMCCPSRSSMLTGKYVHNHNVYTNNENCSSPSWQAMHEPRTFAVYLNNTGYRTAFF GKYLNEYNGSYIPPGWREWLGLIKNSRFYNYTVCRNGIKEKHGFDYAKDYFTDLITNESINYFKMSKRMY PHRPVMMVISHAAPHGPEDSAPQFSKLYPNASQHITPSYNYAPNMDKHWIMQYTGPMLPIHMEFTNILQR KRLQTLMSVDDSVERLYNMLVETGELENTYIIYTADHGYHIGQFGLVKGKSMPYDFDIRVPFFIRGPSVEP GSIVPQIVLNIDLAPTILDIAGLDTPPDVDGKSVLKLLDPEKPGNRFRTNKKAKIWRDTFLVERG corresponding to amino acids 1-416 of SUL1_HUMAN (SEQ ID NO:1419), which also corresponds to amino acids 1-416 of Z21368_PEA_1_P15 (SEQ ID NO:1291).

According to preferred embodiments of the present invention, there is provided an isolated chimeric polypeptide encoding for Z21368_PEA_1_P16 (SEQ ID NO:1292), comprising a first amino acid sequence being at least 90% homologous to MKYSCCALVLAVLGTELLGSLCSTVRSPRFRGRIQQERKNIRPNIILVLTDDQDVELGSLQVMNKTRKIME HGGATFINAFVTTPMCCPSRSSMLTGKYVHNHNVYTNNENCSSPSWQAMHEPRTFAVYLNNTGYRTAFF GKYLNEYNGSYIPPGWREWLGLIKNSRFYNYTVCRNGIKEKHGFDYAKDYFTDLITNESINYFKMSKRMY PHRPVMMVISHAAPHGPEDSAPQFSKLYPNASQHITPSYNYAPNMDKHWIMQYTGPMLPIHMEFTNILQR KRLQTLMSVDDSVERLYNMLVETGELENTYIIYTADHGYHIGQFGLVKGKSMPYDFDIRVPFFIRGPSVEP GSIVPQIVLNIDLAPTILDIAGLDTPPDVDGKSVLKLLDPEKPGNR corresponding to amino acids 1-397 of SUL1_HUMAN (SEQ ID NO:1419), which also corresponds to amino acids 1-397 of Z21368_PEA_1_P16 (SEQ ID NO:1292), and a second amino acid sequence being at least 70%, optionally at least 80%, preferably at least 85%, more preferably at least 90% and most preferably at least 95% homologous to a polypeptide having the sequence CVIVPPLSQPQIH (SEQ ID NO:1761) corresponding to amino acids 398-410 of Z21368_PEA_1_P16 (SEQ ID NO:1292), wherein said first and second amino acid sequences are contiguous and in a sequential order.

According to preferred embodiments of the present invention, there is provided an isolated polypeptide encoding for a tail of Z21368_PEA_1_P16 (SEQ ID NO:1292), comprising a polypeptide being at least 70%, optionally at least about 80%, preferably at least about 85%, more preferably at least about 90% and most preferably at least about 95% homologous to the sequence CVIVPPLSQPQIH (SEQ ID NO:1761) in Z21368_PEA_1_P16 (SEQ ID NO:1292).

According to preferred embodiments of the present invention, there is provided an isolated chimeric polypeptide encoding for Z21368_PEA_1_P22 (SEQ ID NO:1293), comprising a first amino acid sequence being at least 90% homologous to MKYSCCALVLAVLGTELLGSLCSTVRSPRFRGRIQQERKNIRPNIILVLTDDQDVELGSLQVMNKTRKIME HGGATFINAFVTTPMCCPSRSSMLTGKYVHNHNVYTNNENCSSPSWQAMHEPRTFAVYLNNTGYRTAFF GKYLNEYNGSYIPPGWREWLGLIKNSRFYNYTVCRNGIKEKHGFDYAK corresponding to amino acids 1-188 of SUL1_HUMAN (SEQ ID NO:1419), which also corresponds to amino acids 1-188 of Z21368_PEA_1_P22 (SEQ ID NO:1293), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1762) corresponding to amino acids 189-210 of Z21368_PEA_1_P22 (SEQ ID NO:1293), wherein said first and second amino acid sequences are contiguous and in a sequential order.

According to preferred embodiments of the present invention, there is provided an isolated polypeptide encoding for a tail of Z21368_PEA_1_P22 (SEQ ID NO:1293), comprising a polypeptide being at least 70%, optionally at least about 80%, preferably at least about 85%, more preferably at least about 90% and most preferably at least about 95% homologous to the sequence ARYDGDQPRCAPRPRGLSPTVF (SEQ ID NO: 1762) in Z21368_PEA_1_P22 (SEQ ID NO:1293).

According to preferred embodiments of the present invention, there is provided an isolated chimeric polypeptide encoding for Z21368_PEA_1_P23 (SEQ ID NO:1294), comprising a first amino acid sequence being at least 90% homologous to MKYSCCALVLAVLGTELLGSLCSTVRSPRFRGRIQQERKNIRPNIILVLTDDQDVELGSLQVMNKTRKIME HGGATFINAFVTTPMCCPSRSSMLTGKYVHNHNVYTNNENCSSPSWQAMHEPRTFAVYLNNTGYRT corresponding to amino acids 1-137 of Q7Z2W2 (SEQ ID NO:1697), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLLHRLNH (SEQ ID NO: 1763) corresponding to amino acids 138-145 of Z21368_PEA_1_P23 (SEQ ID NO:1294), wherein said first and second amino acid sequences are contiguous and in a sequential order.

According to preferred embodiments of the present invention, there is provided an isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO: 1763) in Z21368_PEA_1_P23 (SEQ ID NO:1294).

According to preferred embodiments of the present invention, there is provided an isolated chimeric polypeptide encoding for Z21368_PEA_1_P23 (SEQ ID NO:1294), comprising a first amino acid sequence being at least 90% homologous to MKYSCCALVLAVLGTELLGSLCSTVRSPRFRGRIQQERKNIRPNIILVLTDDQDVELGSLQVMNKTRKIME HGGATFINAFVTTPMCCPSRSSMLTGKYVHNHNVYTNNENCSSPSWQAMHEPRTFAVYLNNTGYRT corresponding to amino acids 1-137 of SUL1_HUMAN (SEQ ID NO:1419), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

According to preferred embodiments of the present invention, there is provided an isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO: 1763) in Z21368_PEA_1_P23 (SEQ ID NO:1294).

According to preferred embodiments of the present invention, there is provided an isolated chimeric polypeptide encoding for HUMGRP5E_P4 (SEQ ID NO:1299), comprising a first amino acid sequence being at least 90% homologous to MRGSELPLVLLALVLCLAPRGRAVPLPAGG-GTVLTKMYPRGNHWAVGHLMGKKSTGESSSVSER-GSLKQ QLREYIRWEEAARNLLGLIEAKENRN-HQPPQPKALGNQQPSWDSEDSSNFKDVGSKGK corresponding to amino acids 1-127 of GRP_HUMAN (SEQ ID NO:1421), which also corresponds to amino acids 1-127 of HUMGRP5E_P4 (SEQ ID NO:1299), and a second amino acid sequence being at least 90% homologous to GSQRE-GRNPQLNQQ corresponding to amino acids 135-148 of GRP_HUMAN (SEQ ID NO:1421), which also corresponds to amino acids 128-141 of HUMGRP5E_P4 (SEQ ID NO:1299), wherein said first and second amino acid sequences are contiguous and in a sequential order.

According to preferred embodiments of the present invention, there is provided an isolated chimeric polypeptide encoding for an edge portion of HUMGRP5E_P4 (SEQ ID NO:1299), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127-x to 127; and ending at any of amino acid numbers 128+((n−2)−x), in which x varies from 0 to n−2.

According to preferred embodiments of the present invention, there is provided an isolated chimeric polypeptide encoding for HUMGRP5E_P5 (SEQ ID NO:1300), comprising a first amino acid sequence being at least 90% homologous to MRGSELPLVLLALVLCLAPRGRAV-PLPAGGGTVLTKMYPRGNHWAVGHLMGKKSTGESS-SVSERGSLKQ QLREYIRWEEAARNLLGLIEAKENRN-HQPPQPKALGNQQPSWDSEDSSNFKDVGSKGK corresponding to amino acids 1-127 of GRP_HUMAN (SEQ ID NO:1421), which also corresponds to amino acids 1-127 of HUMGRP5E_P5 (SEQ ID NO:1300), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO: 1764) corresponding to amino acids 128-142 of HUMGRP5E_P5 (SEQ ID NO:1300), wherein said first and second amino acid sequences are contiguous and in a sequential order.

According to preferred embodiments of the present invention, there is provided an isolated polypeptide encoding for a tail of HUMGRP5E_P5 (SEQ ID NO:1300), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO: 1764) in HUMGRP5E_P5 (SEQ ID NO:1300).

According to preferred embodiments of the present invention, there is provided an isolated chimeric polypeptide encoding for D56406_PEA_1_P2 (SEQ ID NO:1301), comprising a first amino acid sequence being at least 90% homologous to MMAGMKIQLVCMLLLAFSSWSLCSD-SEEEMKALEADFLTNMHTSKISKAH-VPSWKMTLLNVCSLVNNL NSPAEETGEVHEEELVA-RRKLPTALDGFSLEAMLTIYQLHKICHSRAFQHWE corresponding to amino acids 1-120 of NEUT_HUMAN (SEQ ID NO:1422), which also corresponds to amino acids 1-120 of D56406_PEA_1_P2 (SEQ ID NO:1301), second amino acid sequence being at least 70%, optionally at least 80%, preferably at least 85%, more preferably at least 90% and most preferably at least 95% homologous to a polypeptide having the sequence ARWLTPVIPALWEA-ETGGSRGQEMETIPANT (SEQ ID NO:1773) corresponding to amino acids 121-151 of D56406_PEA_1_P2 (SEQ ID NO:1301), and a third amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 152-201 of D56406_PEA_1_P2 (SEQ ID NO:1301), wherein said first, second and third amino acid sequences are contiguous and in a sequential order.

According to preferred embodiments of the present invention, there is provided an isolated polypeptide encoding for an edge portion of D56406_PEA_1_P2 (SEQ ID NO:1301), comprising an amino acid sequence being at least 70%, optionally at least about 80%, preferably at least about 85%, more preferably at least about 90% and most preferably at least about 95% homologous to the sequence encoding for ARWLTPVIPALWEAETGGSRGQEMETIPANT (SEQ ID NO:1773), corresponding to D56406_PEA_1_P2 (SEQ ID NO:1301).

According to preferred embodiments of the present invention, there is provided an isolated chimeric polypeptide encoding for D56406_PEA_1_P5 (SEQ ID NO:1302), comprising a first amino acid sequence being at least 90% homologous to MMAGMKIQLVCMLLLAFSSWSLC corresponding to amino acids 1-23 of NEUT_HUMAN (SEQ ID NO:1422), which also corresponds to amino acids 1-23 of D56406_PEA_1_P5 (SEQ ID NO:1302), and a second amino acid sequence being at least 90% homologous to SEEEMKALEADFLTNMHTSKISKAHVPSWKMTLLN-VCSLVNNLNSPAEETGEVHEEELVARRKLPTALDG FSLEAMLTIYQLHKICHSRAFQHWELIQEDILDTGN-DKNGKEEVIKRKIPYILKRQLYENKPRRPYILKRDS YYY corresponding to amino acids 26-170 of NEUT_HU-MAN (SEQ ID NO:1422), which also corresponds to amino acids 24-168 of D56406_PEA_1_P5 (SEQ ID NO:1302), wherein said first and second amino acid sequences are contiguous and in a sequential order.

According to preferred embodiments of the present invention, there is provided an isolated chimeric polypeptide encoding for an edge portion of D56406_PEA_1_P5 (SEQ ID NO:1302), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23-x to 24; and ending at any of amino acid numbers+((n−2)−x), in which x varies from 0 to n−2.

According to preferred embodiments of the present invention, there is provided an isolated chimeric polypeptide encoding for D56406_PEA_1_P6 (SEQ ID NO:1303), comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN (SEQ ID NO:1422), which also corresponds to amino acids 1-45 of D56406_PEA_1_P6 (SEQ ID NO:1303), and a second amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 46-95 of D56406_PEA_1_P6 (SEQ ID NO:1303), wherein said first and second amino acid sequences are contiguous and in a sequential order.

According to preferred embodiments of the present invention, there is provided an isolated chimeric polypeptide encoding for an edge portion of D56406_PEA_1_P6 (SEQ ID NO:1303), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45-x to 46; and ending at any of amino acid numbers 46+((n−2)−x), in which x varies from 0 to n−2.

According to preferred embodiments of the present invention, there is provided an isolated chimeric polypeptide encoding for F05068_PEA_1_P7 (SEQ ID NO:1304), comprising a first amino acid sequence being at least 90% homologous to MKLVSVALMYLGSLAFLGADTARLD-VASEFRKK corresponding to amino acids 1-33 of ADML_HUMAN (SEQ ID NO:1423), which also corresponds to amino acids 1-33 of F05068_PEA_1_P7 (SEQ ID NO:1304).

According to preferred embodiments of the present invention, there is provided an isolated chimeric polypeptide encoding for F05068_PEA_1_P8 (SEQ ID NO:1305), comprising a first amino acid sequence being at least 90% homologous to MKLVSVALMYLGSLAFLGADTARLD-VASEFRKKWNKWALSRGKREL-RMSSSYPTGLADVKAGPAQTLI RPQDMKGASRSPED corresponding to amino acids 1-82 of ADML_HUMAN (SEQ ID NO:1423), which also corresponds to amino acids 1-82 of F05068_PEA_1_P8 (SEQ ID NO:1305), and a second amino acid sequence being at least 70%, optionally at least 80%, preferably at least 85%, more preferably at least 90% and most preferably at least 95% homologous to a polypeptide having the sequence R corresponding to amino acids 83-83 of F05068_PEA_1_P8 (SEQ ID NO:1305), wherein said first and second amino acid sequences are contiguous and in a sequential order.

According to preferred embodiments of the present invention, there is provided an isolated chimeric polypeptide encoding for H14624_P15 (SEQ ID NO:1306), comprising a first amino acid sequence being at least 90% homologous to MLQGPGSLLLLFLASHCCLGSARGLFLFGQPDFSY-KRSNCKPIPANLQLCHGIEYQNMRLPNLLGHETMKE VLEQAGAWIPLVMKQCHPDTKKFLCSLFAPVCLDD-LDETIQPCHSLCVQVKDRCAPVMSAFGFPWPDML ECDRFPQDNDLCIPLASSDHLLPATEE corresponding to amino acids 1-167 of Q9HAP5 (SEQ ID NO:1701), which also corresponds to amino acids 1-167 of H14624_P15 (SEQ ID NO:1306), and a second amino acid sequence being at least 70%, optionally at least 80%, preferably at least 85%, more preferably at least 90% and most preferably at least 95% homologous to a polypeptide having the sequence GKPSLLLPHSLLG (SEQ ID NO: 1765) corresponding to amino acids 168-180 of H14624_P15 (SEQ ID NO:1306), wherein said first and second amino acid sequences are contiguous and in a sequential order.

According to preferred embodiments of the present invention, there is provided an isolated polypeptide encoding for a tail of H14624_P15 (SEQ ID NO:1306), comprising a polypeptide being at least 70%, optionally at least about 80%, preferably at least about 85%, more preferably at least about 90% and most preferably at least about 95% homologous to the sequence GKPSLLLPHSLLG (SEQ ID NO: 1765) in H14624_P15 (SEQ ID NO:1306).

According to preferred embodiments of the present invention, there is provided an isolated chimeric polypeptide encoding for H38804_PEA_1_P5 (SEQ ID NO:1307), comprising a first amino acid sequence being at least 70%, optionally at least 80%, preferably at least 85%, more preferably at least 90% and most preferably at least 95% homologous to a polypeptide having the sequence MGRVRTLAGEC-SAQAQAQSLLAVVLSAPPSGGTPSARLS-VRSPSPRDPWGLWAPVLQ (SEQ ID NO:1766) corresponding to amino acids 1-57 of H38804_PEA_1_P5 (SEQ ID NO:1307), and a second amino acid sequence being at least 90% homologous to MTGSNEFKLNQPPEDGISS-VKFSPNTSQFLLVSSWDTSVRLYDVPANSMRLKYQ-HTGAVLDCAFYDPTHA WSGGLDHQLKMHDLNT-DQENLVGTHDAPIRCVEYCPEVNVMVTGSWDQTV-KLWDPRTPCNAGTFSQPE KVYTLSVSGDRLIVG-TAGRRVLVWDLRNMGYVQQRRESSLKYQTRCIRA-FPNKQGYVLSSIEGRVAVEYL DPSPEVQKKKYAF-KCHRLKENNIEQIYPVNAISFHNIHNTFATGGSD-GFVNIWDPFNKKRLCQFHRYPTSIA SLAFSNDGT-TLAIASSYMYEMDDTEHPEDGIFIRQVTDAETKPK corresponding to amino acids 1-324 of BUB3_HUMAN (SEQ ID NO:1424), which also corresponds to amino acids 58-381 of H38804_PEA_1_P5 (SEQ ID NO:1307), wherein said first and second amino acid sequences are contiguous and in a sequential order.

According to preferred embodiments of the present invention, there is provided an isolated polypeptide encoding for a head of H38804_PEA_1_P5 (SEQ ID NO:1307), comprising a polypeptide being at least 70%, optionally at least about 80%, preferably at least about 85%, more preferably at least about 90% and most preferably at least about 95% homologous to the sequence MGRVRTLAGECSAQAQAQSLLAV-VLSAPPSGGTPSARLSVRSPSPRDPWGLWAPVLQ (SEQ ID NO:1766) of H38804_PEA_1_P5 (SEQ ID NO:1307).

According to preferred embodiments of the present invention, there is provided an isolated chimeric polypeptide encoding for H38804_PEA_1_P17 (SEQ ID NO:1308), comprising a first amino acid sequence being at least 70%, optionally at least 80%, preferably at least 85%, more preferably at least 90% and most preferably at least 95% homologous to a polypeptide having the sequence MGRVRT-LAGECSAQAQAQSLLAVVLSAPPSGGTPSARLSVRSP-SPRDPWGLWAPVLQ (SEQ ID NO:1766) corresponding to amino acids 1-57 of H38804_PEA_1_P17 (SEQ ID NO:1308), and a second amino acid sequence being at least 90% homologous to MTGSNEFKLNQPPEDGISSVKFSP-NTSQFLLVSSWDTSVRLYDVPANSMRLKYQHTG- AVLDCAFYDPTHA WSGGLDHQLKMHDLNTDQEN-LVGTHDAPIRCVEYCPEVNVMVTGSWDQTVKL-WDPRTPCNAGTFSQPE KVYTLSVSGDRLIVGTAGR-RVLVWDLRNMGYVQQRRESSLKYQTRCIRAFPNK-QGYVLSSIEGRVAVEYL DPSPEVQKKKYAFKCHRLK-ENNIEQIYPVNAISFHNIHNTFATGGS-DGFVNIWDPFNKKRLCQFHRYPTSIA SLAFSNDGT-TLAIASSYMYEMDDTEHPEDGIFIRQVTDAETKPKSP-CT corresponding to amino acids 1-328 of BUB3_HUMAN (SEQ ID NO:1424), which also corresponds to amino acids 58-385 of H38804_PEA_1_P17 (SEQ ID NO:1308), wherein said first and second amino acid sequences are contiguous and in a sequential order.

According to preferred embodiments of the present invention, there is provided an isolated polypeptide encoding for a head of H38804_PEA_1_P17 (SEQ ID NO:1308), comprising a polypeptide being at least 70%, optionally at least about 80%, preferably at least about 85%, more preferably at least about 90% and most preferably at least about 95% homologous to the sequence MGRVRTLAGECSAQAQAQSLLAV-VLSAPPSGGTPSARLSVRSPSPRDPWGLWAPVLQ (SEQ ID NO:1766) of H38804_PEA_1_P 17 (SEQ ID NO:1308).

According to preferred embodiments of the present invention, there is provided an isolated chimeric polypeptide encoding for HSENA78_P2 (SEQ ID NO:1309), comprising a first amino acid sequence being at least 90% homologous to MSLLSSRAARVPGPSSSLCALLV-LLLLLTQPGPIASAGPAAAVLRELRCV-CLQTTQGVHPKMISNLQVFAIG PQCSKVEVV corresponding to amino acids 1-81 of SZ05_HUMAN (SEQ ID NO:1425), which also corresponds to amino acids 1-81 of HSENA78_P2 (SEQ ID NO:1309).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO:1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFVQAIS-DARCVFDM GAEVGFSMYLLDIGGGFPGSEDVKLK-FEEITGVINPALDKYFPSDSGVRIIAEPGRYYVASAF-TLAVNIIAKK IVLKEQTGSDDEDESSEQTFMYYVN-DGVYGSFNCILYDHAHVKPLLQKRPKP-DEKYYSSSIWGPTCDGLD RIVERCDLPEMHVGDWM-LFENMGAYTVAAASTFNGFQRPTIYYVMSGPAWQL-MQQFQNPDFPPEVEEQ DASTLPVSCAWESG-MKRHRAACASASINV corresponding to amino acids 151-461 of DCOR_HUMAN (SEQ ID NO:1426), which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA_P9 (SEQ ID NO:1310).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFVQAISD-ARCVFDM GAEVGFSMYLLDIGGGFPGSEDVKLK-FEEITGVINPALDKYFPSDSGVRIIAEPGRYYVASAF-TLAVNIIAKK IVLKEQTGSDDEDESSEQTFMYYVND-GVYGSFNCILYDHAHVKPLLQKRPKPDEKYYSSS-IWGPTCDGLD RIVERCDLPEMHVGDWMLFENM-GAYTVAAASTFNGFQRPTIYYVMSGPAWQLMQQF-QNPDFPPEVEEQ DASTLPVSCAWESGMKRHRAA-CASASINV corresponding to amino acids 40-350 of AAA59968, which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA_P9 (SEQ ID NO:1310).

According to preferred embodiments of the present invention, there is provided an isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLL-PRTFWTRKLMKFLLL (SEQ ID NO:1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFVQAISD-ARCVFDM GAEVGFSMYLLDIGGGFPGSEDVKLK-FEEITGVINPALDKYFPSDSGVRIIAEPGRYYVASAF-TLAVNIIAKK IVLKEQTGSDDEDESSEQTFMYYVND-GVYGSFNCILYDHAHVKPLLQKRPKPDEKYYSSSI-WGPTCDGLD RIVERCDLPEMHVGDWMLFENMGAY-TVAAASTFNGFQRPTIYYVMSGPAWQLMQQFQNPD-FPPEVEEQ DASTLPVSCAWESGMKRHRAACASAS-INV corresponding to amino acids 86-396 of AAH14562 (SEQ ID NO:1703), which also corresponds to amino acids 30-340 of HUMODCA_P9 (SEQ ID NO:1310), wherein said first and second amino acid sequences are contiguous and in a sequential order.

According to preferred embodiments of the present invention, there is provided an isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMK-FLLL (SEQ ID NO:1768) of HUMODCA P9 (SEQ ID NO:1310).

According to preferred embodiments of the present invention, there is provided an isolated chimeric polypeptide encoding for R00299_P3 (SEQ ID NO:1311), comprising a first amino acid sequence being at least 70%, optionally at least 80%, preferably at least 85%, more preferably at least 90% and most preferably at least 95% homologous to a polypeptide having the sequence MAEKALLCPSSA-GLGTWPWVLNSAWPVLPLAVDQGVDWRPRGPV (SEQ ID NO:1769) corresponding to amino acids 1-44 of R00299_P3 (SEQ ID NO:1311), second amino acid sequence being at least 90% homologous to SSDQIEQLHRRFKQLS-GDQPTIRKENFNNVPDLELNPIR-SKIVRAFFDNRNLRKGPSGLADEINFEDFLTIMS YFRPIDTTMDEEQVELSRKEKLRFLFH-MYDSDSDGRITLEEYRNV corresponding to amino acids 74-191 of Q9NWT9 (SEQ ID NO:1704), which also corresponds to amino acids 45-162 of R00299_P3 (SEQ ID NO:1311), and a third amino acid sequence being at least 70%, optionally at least 80%, preferably at least 85%, more preferably at least 90% and most preferably at least 95% homologous to a polypeptide having the sequence VEELLS-GNPHIEKESARSIADGAMMEAASVC-MGQMEPDQVYEGITFEDFLKIWQGIDI-ETKMHVRFLNME TMALCH (SEQ ID NO:1770) corresponding to amino acids 163-238 of R00299_P3 (SEQ ID NO:1311), wherein said first, second and third amino acid sequences are contiguous and in a sequential order.

According to preferred embodiments of the present invention, there is provided an isolated polypeptide encoding for a head of R00299_P3 (SEQ ID NO: 1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPV-LPLAVDQGVDWRPRGPV (SEQ ID NO:1769) of R00299_P3 (SEQ ID NO:1311).

According to preferred embodiments of the present invention, there is provided an isolated polypeptide encoding for a tail of R00299_P3 (SEQ ID NO:1311), comprising a polypeptide being at least 70%, optionally at least about 80%, preferably at least about 85%, more preferably at least about 90% and most preferably at least about 95% homologous to the sequence VEELLSGNPHIEKESARSIADGAM-MEAASVCMGQMEPDQVYEGITFEDFLKI-WQGIDIETKMHVRFLNME TMALCH (SEQ ID NO: 1770) in R00299_P3 (SEQ ID NO:1311).

According to preferred embodiments of the present invention, there is provided an isolated chimeric polypeptide encoding for R00299_P3 (SEQ ID NO: 1311), comprising a first amino acid sequence being at least 70%, optionally at least 80%, preferably at least 85%, more preferably at least 90% and most preferably at least 95% homologous to a polypeptide having the sequence MAEKALLCPSSA-GLGTWPWVLNSAWPVLPLAVDQGVDWRPRGPV (SEQ ID NO: 1769) corresponding to amino acids 1-44 of R00299_P3 (SEQ ID NO:1311), and a second amino acid sequence being at least 90% homologous to SSDQIEQLHR-RFKQLSGDQPTIRKENFNNVPDLELN-PIRSKIVRAFFDNRNLRKGPSGLADEINFEDFLTIMS YFRPIDTTMDEEQVELSRKEKLRFLFH-MYDSDSDGRITLEEYRNVVEELLSGN-PHIEKESARSIADGAMME AASVCMGQMEPDQVYE-GITFEDFLKIWQGIDIETKMHVRFLNMETMALCH (SEQ ID NO:1770) corresponding to amino acids 21-214 of TESC_HUMAN (SEQ ID NO:1427), which also corresponds to amino acids 45-238 of R00299_P3 (SEQ ID NO:1311), wherein said first and second amino acid sequences are contiguous and in a sequential order.

According to preferred embodiments of the present invention, there is provided an isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPV-LPLAVDQGVDWRPRGPV (SEQ ID NO:1769) of R00299_P3 (SEQ ID NO:1311).

According to preferred embodiments of the present invention, there is provided an isolated chimeric polypeptide encoding for W60282_PEA_1_P14 (SEQ ID NO:1312), comprising a first amino acid sequence being at least 90% homologous to MRILQLILLALATGLVGGETRIIKG-FECKPHSQPWQAALFEKTR-LLCGATLIAPRWLLTAAHCLKP corresponding to amino acids 1-66 of Q8IXD7 (SEQ ID NO:1705), which also corresponds to amino acids 1-66 of W60282_PEA_1_P14 (SEQ ID NO:1312), and a second amino acid sequence being at least 70%, optionally at least 80%, preferably at least 85%, more preferably at least 90% and most preferably at least 95% homologous to a polypeptide having the sequence TPA-SHLAMRQHHHH (SEQ ID NO:1771) corresponding to amino acids 67-80 of W60282_PEA_1_P14 (SEQ ID NO:1312), wherein said first and second amino acid sequences are contiguous and in a sequential order.

According to preferred embodiments of the present invention, there is provided an isolated polypeptide encoding for a tail of W60282_PEA_1_P14 (SEQ ID NO:1312), comprising a polypeptide being at least 70%, optionally at least about 80%, preferably at least about 85%, more preferably at least about 90% and most preferably at least about 95% homologous to the sequence TPASHLAMRQHHHH (SEQ ID NO:1771) in W60282_PEA_1_P14 (SEQ ID NO:1312).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPH-CEEKMVIITFKSVSRYRGQE HCLHPKLQSTKRFIKW-YNAWNEKRR corresponding to amino acids 1-95 of SZ14_HUMAN (SEQ ID NO:1429), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPH-CEEKMVIITTKSVSRYRGQE HCLHPKLQSTKRFIKW-YNAWNEKRR corresponding to amino acids 13-107 of Q9NS21 (SEQ ID NO:1706), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO: 1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an isolated chimeric polypeptide encoding for Z41644_PEA_1_P10 (SEQ ID NO:1313), comprising a first amino acid sequence being at least 90% homologous to MRLLAAALLLLLLALYTARVDG-SKCKCSRKGPKIRYSDVKKLEMKPKYPH-CEEKMVIITTKSVSRYRGQE HCLHPKLQSTKRFIKW-YNAWNEKRR corresponding to amino acids 13-107 of AAQ89265 (SEQ ID NO:781), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO:1772) corresponding to amino acids 96-123 of Z41644_PEA_1_P10 (SEQ ID NO:1313), wherein said first and second amino acid sequences are contiguous and in a sequential order.

According to preferred embodiments of the present invention, there is provided an isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGP-PHQVI (SEQ ID NO:1772) in Z41644_PEA_1_P10 (SEQ ID NO:1313).

According to preferred embodiments of the present invention, there is provided an antibody capable of specifically binding to an epitope of an amino acid sequences.

Optionally the amino acid sequence corresponds to a bridge, edge portion, tail, head or insertion.

Optionally the antibody is capable of differentiating between a splice variant having said epitope and a corresponding known protein.

According to preferred embodiments of the present invention, there is provided a kit for detecting lung cancer, comprising a kit detecting overexpression of a splice variant according to any of the above claims.

Optionally the kit comprises a NAT-based technology.

Optionally the kit further comprises at least one primer pair capable of selectively hybridizing to a nucleic acid sequence according to any of the above claims.

Optionally the kit further comprises at least one oligonucleotide capable of selectively hybridizing to a nucleic acid sequence according to any of the above claims.

Optionally the kit comprises an antibody according to any of the above claims.

Optionally the kit further comprises at least one reagent for performing an ELISA or a Western blot.

According to preferred embodiments of the present invention, there is provided a method for detecting lung cancer, comprising detecting overexpression of a splice variant according to any of the above claims.

Optionally the detecting overexpression is performed with a NAT-based technology.

Optionally detecting overexpression is performed with an immunoassay.

Optionally the immunoassay comprises an antibody according to any of the above claims.

According to preferred embodiments of the present invention, there is provided a biomarker capable of detecting lung cancer, comprising any of the above nucleic acid sequences or a fragment thereof, or any of the above amino acid sequences or a fragment thereof.

According to preferred embodiments of the present invention, there is provided a method for screening for lung cancer, comprising detecting lung cancer cells with a biomarker or an antibody or a method or assay according to any of the above claims.

According to preferred embodiments of the present invention, there is provided a method for diagnosing lung cancer, comprising detecting lung cancer cells with a biomarker or an antibody or a method or assay according to any of the above claims.

According to preferred embodiments of the present invention, there is provided a method for monitoring disease progression and/or treatment efficacy and/or relapse of lung cancer, comprising detecting lung cancer cells with a biomarker or an antibody or a method or assay according to any of the above claims.

According to preferred embodiments of the present invention, there is provided a method of selecting a therapy for lung cancer, comprising detecting lung cancer cells with a biomarker or an antibody or a method or assay according to any of the above claims and selecting a therapy according to said detection.

According to some embodiments of the present invention, there is provided an isolated polynucleotide comprising the polynucleotide sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto.

According to some embodiments of the present invention, there is provided an isolated polypeptide comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776, or a sequence at least about 95% identical thereto.

According to some embodiments of the present invention, there is provided an expression vector comprising anyone of the foregoing polynucleotide sequences.

According to some embodiments of the present invention, there is provided a host cell comprising the foregoing vector.

According to some embodiments of the present invention, there is provided a process for producing a polypeptide comprising:

culturing the foregoing host cell under conditions suitable to produce the polypeptide encoded by said polynucleotide; and recovering said polypeptide.

According to some embodiments of the present invention, there is provided an isolated primer pair, comprising the pair of nucleic acid sequences selected from the group consisting of: SEQ NOs: 1478-1479, 1515-1516, 1527-1528, 1530-1531, 1556-1557, 1572-1573, 1592-1593, 1598-1599, 1614-1615, 1617-1618, 1620-1621, 1623-1624, 1634-1635, 1637-1638, 1640-1641, 1643-1644, 1646-1547, 1649-1650, 1652-1653, 1655-1656, 1658-1659, 1661-1662, 1664-1665, 1667-1668, 1670-1671, 1673-1674, 1676-1677, 1679-1680, 1682-1683, 1685-1686, 1688-1689, 1691-1692.

According to some embodiments of the present invention, there is provided an antibody to specifically bind to anyone of the foregoing polypeptides.

According to some embodiments of the present invention, there is provided a kit for detecting lung cancer, comprising at least one of the foregoing primer pairs.

According to some embodiments of the present invention, there is provided a kit for detecting lung cancer, comprising the foregoing antibody.

According to further embodiments of the present invention, there is provided the foregoing kit, wherein said immunoassay is selected from the group consisting of an enzyme linked immunosorbent assay (ELISA), an immunoprecipitation assay, an immunofluorescence analysis, an enzyme immunoassay (EIA), a radioimmunoassay (RIA), or a Western blot analysis.

According to some embodiments of the present invention, there is provided a method for detecting lung cancer, comprising detecting overexpression of the polynucleotide sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto in a sample from a patient.

According to further embodiments of the present invention, there is provided the foregoing method for detecting lung cancer, wherein said detecting overexpression comprises performing nucleic acid amplification.

According to some embodiments of the present invention, there is provided a method for detecting lung cancer, comprising detecting overexpression of the polypeptide comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776 in a sample from a patient.

According to further embodiments of the present invention, there is provided the foregoing method for detecting lung cancer, wherein said detecting comprises detecting binding of the foregoing antibody to the polypeptide comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776 in a sample from a patient.

According to some embodiments of the present invention, there is provided a biomarker for detecting lung cancer, comprising an amino acid sequence comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776, or a sequence at least about 95% identical thereto, marked with a label.

According to some embodiments of the present invention, there is provided a method to screen for or to diagnose lung cancer, comprising detecting the disease with the biomarker comprising an amino acid sequence comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776, or a sequence at least about 95% identical thereto.

According to some embodiments of the present invention, there is provided a method for monitoring disease progression, treatment efficacy or relapse of lung cancer, comprising detecting the disease with the biomarker comprising an amino acid sequence comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776, or a sequence at least about 95% identical thereto.

According to some embodiments of the present invention, there is provided a method of selecting a therapy for lung cancer, comprising detecting the disease with the biomarker comprising an amino acid sequence comprising the polypeptide sequence set forth in a member selected from the group consisting of SEQ ID NOs: 251-279, 324-325, 369, 622, 694, 1281-1294, 1299-1415, 1508-1511, 1523, 1569-1571, 1581, 1583, 1585, 1613, 1627-1629, 1702, and 1717-1776, or a sequence at least about 95% identical thereto, and selecting a therapy according to said detection.

According to some embodiments of the present invention, there is provided a biomarker for detecting lung cancer, comprising a nucleotide acid sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto.

According to some embodiments of the present invention, there is provided a method to screen for or to diagnose lung cancer, comprising detecting the disease with the biomarker comprising a nucleotide acid sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto.

According to some embodiments of the present invention, there is provided a method for monitoring disease progression, treatment efficacy or relapse of lung cancer, comprising detecting the disease with the biomarker comprising a nucleotide acid sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto.

According to some embodiments of the present invention, there is provided a method of selecting a therapy for lung cancer, comprising detecting the disease with the biomarker comprising a nucleotide acid sequence set forth in a member selected from the group consisting of SEQ ID NOs: 1-195, 204-250, 306-323, 335-693, 695-1021, 1067-1100, 1276-1280, 1464-1465, 1480, 1512-1514, 1517, 1529, 1532, 1558, 1574, 1594, 1600, 1616, 1619, 1622, 1625, 1626, 1636, 1639, 1642, 1645, 1648, 1651, 1654, 1657, 1660, 1663, 1666, 1669, 1672, 1675, 1678, 1681, 1684, 1687, 1690, and 1693, or a sequence at least about 95% identical thereto and selecting a therapy according to said detection.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

BRIEF DESCRIPTION OF DRAWINGS

FIG. 1 is schematic summary of cancer biomarkers selection engine and the wet validation stages.

FIG. 2. Schematic illustration, depicting grouping of transcripts of a given contig based on presence or absence of unique sequence regions.

FIG. 56a shows the results on scale: 0-1200. FIG. 56b shows the results on scale: 0-24.

FIG. 57a shows the results on scale: 0-2000. FIG. 57b shows the results on scale: 0-42.

FIG. 63 is an amino acid sequence alignment, using NCBI BLAST default parameters, demonstrating similarity between the AA281370 lung cancer biomarker if the present invention to WD40 domains of various proteins involved in MAPK signal trunsduction pathway. FIG. 63a: amino acids at positions 40-790 of AA281370 polypeptide SEQ ID NO: 99 has 75% homology to mouse Mapkbp1 protein (gi|47124622). FIG. 63b: amino acids at positions 40-886 of the AA281370 polypeptide SEQ ID NO: 99 has 70% homology to rat JNK-binding protein JNKBP1 (gi|34856717).

FIG. 79 shows PSEC R11723_PEA_1 T5 (SEQ ID NO:148) PCR product; Lane 1: PCR product; and Lane 2: Low DNA Mass Ladder MW marker (Invitrogen Cat# 10068-013).

FIG. 80: PSEC R11723_PEA_1 T5 PCR product sequence; In Red-PSEC Forward primer; In Blue-PSEC Reverse complementary sequence; and Highlighted sequence—PSEC variant R11723_PEA_1 T5 (SEQ ID NO:148) ORF.

FIG. 83: Protein sequence of PSEC variant R11723_PEA_1 T5 (SEQ ID NO:148); In red-6H is tag; In blue—PSEC.

FIG. 84 shows the DNA sequence of His PSEC T5 pRSETA; bold—His PSEC T5 open reading frame; Italic—flanking DNA sequence which was verified by sequence analysis.

FIG. 86 shows the DNA sequences of WT MMP11 (MMP11_488, (SEQ ID NO:1782)) and HSSTROL3_P9 (MMP11_354, (SEQ ID NO:1783)) used for mammalian expression. NcoI and Not I sites used to subclone MMP11 fragments into bacterial vectors, without the signal peptide are underlined. Translation initiation site and stop codons are shown in bold.

FIG. 87 shows Protein sequences used for mammalian expression of WT MMP11 (MMP11_488 (SEQ ID NO:1784)) and HSSTROL3_P9 (MMP11_354 (SEQ ID NO:1785)). His-tag of 8 His residues is shown in bold.

FIG. 90 shows protein sequences used for bacterial expression of WT MMP11 (MMP11_488) and HSSTROL3_P9 (MMP11_354). His-tag of 8 His residues is shown in bold.

FIG. 93 shows an overlay of the immunogen Peptide CGEN6301 (SEQ ID NO:1781) on the primary sequence of the HSSTROL3_P9 protein (SEQ ID NO:1398). The Peptide CGEN6301 (SEQ ID NO:1781) sequence is shown in bold.

FIG. 98 shows the alignment of HUMGRP5E P5 ((SEQ ID NO:1300), indicated in the Figure as CgenGRP)) and Wild Type GRP isoforms WT GPR 1 (SEQ ID NOs:1421), WT GPR 2 (SEQ ID NOs: 1788), WT GPR 3 (SEQ ID NOs:1789) protein sequences.

FIG. 99a shows the GRP 148 DNA optimized ORF sequence (SEQ ID NO: 1790). EcoRI and NotI restriction sites are underlined. Open reading frame is shown in bold.

FIG. 99b shows the GRP 142 DNA optimized ORF sequence (SEQ ID NO: 1791). EcoRI and NotI restriction sites are underlined. Open reading frame is shown in bold.

FIG. 100a shows the protein sequence of recombinant GRP-148 (SEQ ID NO: 1792). IL6 signal peptide is shown in bold. The 8×His tag is underlined.

FIG. 100b shows the protein sequence of recombinant GRP-142 (SEQ ID NO: 1793). IL6 signal peptide is shown in bold. The 8×His tag is underlined.

FIG. 105 shows an overlay of HUMGRP5E_P5 immunogen (SEQ ID NO:1795) on HUMGRP5E_P5 ((SEQ ID NO:1300) protein sequence. The immunogen sequence is shown in bold.

DESCRIPTION OF PREFERRED EMBODIMENTS

Figure 3:
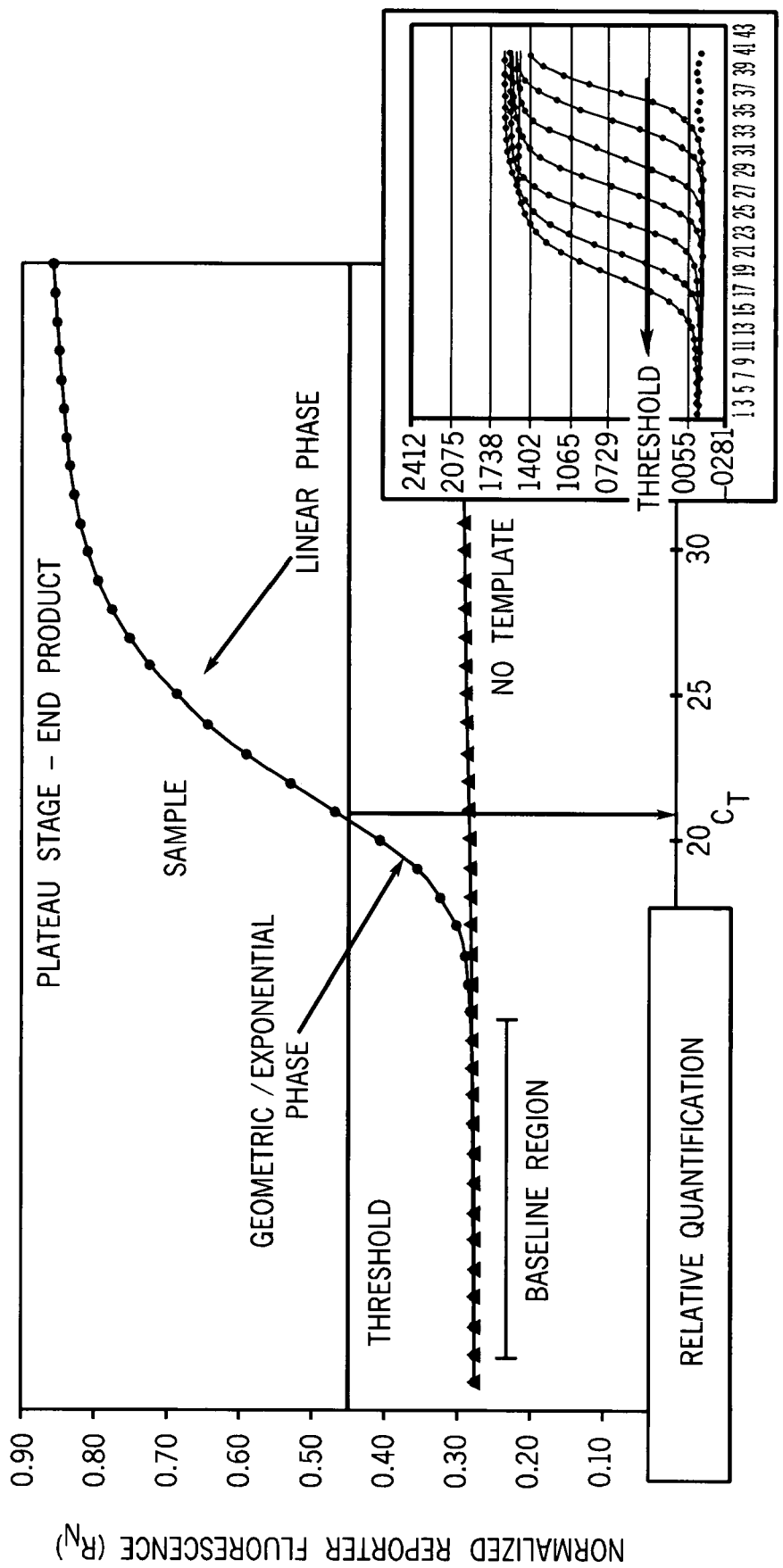
FIG. 3 is schematic summary of quantitative real-time PCR analysis.

The present invention is of novel markers for lung cancer that are both sensitive and accurate. Furthermore, at least certain of these markers are able to distinguish between various types of lung cancer, such as small cell carcinoma; large cell carcinoma; squamous cell carcinoma; and adenocarcinoma, alone or in combination. These markers are differentially expressed, and preferably overexpressed, in lung cancer specifically, as opposed to normal lung tissue. The measurement of these markers, alone or in combination, in patient samples provides information that the diagnostician can correlate with a probable diagnosis of lung cancer. The markers of the present invention, alone or in combination, show a high degree of differential detection between lung cancer and non-cancerous states. The markers of the present invention, alone or in combination, can be used for prognosis, prediction, screening, early diagnosis, therapy selection and treatment monitoring of lung cancer. For example, optionally and preferably, these markers may be used for staging lung cancer and/or monitoring the progression of the disease. Furthermore, the markers of the present invention, alone or in combination, can be used for detection of the source of metastasis found in anatomical places other than lung. Also, one or more of the markers may optionally be used in combination with one or more other lung cancer markers (other than those described herein). According to an optional embodiment of the present invention, such a combination may be used to differentiate between various types of lung cancer, such as small cell carcinoma; large cell carcinoma; squamous cell carcinoma; and adenocarcinoma. Furthermore, the markers of the present invention, alone or in combination, can be used for detection of other types of tumors by elimination (for example, for such detection of carcinoid tumors, which are 5% of lung cancers).

The markers of the present invention, alone or in combination, can be used for prognosis, prediction, screening, early diagnosis, staging, therapy selection and treatment monitoring of lung cancer. For example, optionally and preferably, these markers may be used for staging lung cancer and/or monitoring the progression of the disease. Furthermore, the markers of the present invention, alone or in combination, can be used for detection of the source of metastasis found in anatomical places other then lung. Also, one or more of the markers may optionally be used in combination with one or more other lung cancer markers (other than those described herein).

Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of lung cancer, and/or are otherwise expressed at a much higher level and/or specifically expressed in lung cancer tissue or cells. The measurement of these markers, alone or in combination, in patient samples provides information that the diagnostician can correlate with a probable diagnosis of lung cancer.

The present invention therefore also relates to diagnostic assays for lung cancer and/or an indicative condition, and methods of use of such markers for detection of lung cancer and/or an indicative condition, optionally and preferably in a sample taken from a subject (patient), which is more preferably some type of blood sample.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49-x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49-x (for example) is not less than 1, nor 50+((n−2)−x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing lung cancer. Each splice variant marker of the present invention can be used alone or in combination, for various uses, including but not limited to, prognosis, prediction, screening, early diagnosis, determination of progression, therapy selection and treatment monitoring of lung cancer.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting lung cancer, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos: 4,469,863; 4,476, 301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264, 166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in E. coli (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. (dot invitrogen dot com). Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1 M NaCl, 1% SDS and $5 \times 10^6$ cpm $^{32}$P labeled probe, at 65° C., with a final wash solution of 0.2× SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S, Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, Fluor X (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR). The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo- and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mismatch. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation. Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a non-denaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station. describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153: 516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Optionally, nucleic acid sequence identity/homology may be determined by using BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2—NH, CH2—S, CH2—S=O, O=C—NH, CH2—O, CH2—CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH$_3$)—CO—), ester bonds (—C(R)H—C—O—O—C(R)—N—), ketomethylen bonds (—CO—CH$_2$—), a-aza bonds (—NH—N(R)—CO—), wherein R is any alkyl, e.g., methyl, carba bonds (—CH$_2$—NH—), hydroxyethylene bonds (—CH(OH)—CH$_2$—), thioamide bonds (—CS—NH—), olefinic double bonds (—CH=CH—), retro amide bonds (—NH—CO—), peptide derivatives (—N(R)—CH$_2$—CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table 1 non-conventional or modified amino acids which can be used with the present invention.

TABLE 1

| Non-conventional amino acid | Code | Non-conventional amino acid | Code |
|---|---|---|---|
| α-aminobutyric acid | Abu | L-N-methylalanine | Nmala |
| α-amino-α-methylbutyrate | Mgabu | L-N-methylarginine | Nmarg |
| aminocyclopropane-Carboxylate | Cpro | L-N-methylasparagine | Nmasn |
| | | L-N-methylaspartic acid | Nmasp |
| Aminoisobutyric acid | Aib | L-N-methylcysteine | Nmcys |

TABLE 1-continued

| Non-conventional amino acid | Code | Non-conventional amino acid | Code |
|---|---|---|---|
| aminonorbornyl-Carboxylate | Norb | L-N-methylglutamine | Nmgin |
| | | L-N-methylglutamic acid | Nmglu |
| Cyclohexylalanine | Chexa | L-N-methylhistidine | Nmhis |
| Cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmom |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcyclopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmhleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cyclododeclglycine | Ncdod |
| D-α-methylalnine | Dnmala | N-cyclooctylglycine | Ncoct |
| D-α-methylarginine | Dnmarg | N-cyclopropylglycine | Ncpro |
| D-α-methylasparagine | Dnmasn | N-cycloundecylglycine | Ncund |
| D-α-methylasparatate | Dnmasp | N-(2,2-diphenylethyl)glycine | Nbhm |
| D-α-methylcysteine | Dnmcys | N-(3,3-diphenylpropyl)glycine | Nbhe |
| D-N-methylleucine | Dmnleu | N-(3-indolylyethyl) glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nva |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomo phenylalanine | Mhphe |
| L-α-methylisoleucine | Mile | N-(2-methylthioethyl)glycine | Nmet |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl)glycine | Nser |
| D-N-methylisoleucine | Dnmile | N-(imidazolylethyl)glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |

TABLE 1-continued

| Non-conventional amino acid | Code | Non-conventional amino acid | Code |
|---|---|---|---|
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Thug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | mser | L-α-methylthreonine | Mthr |
| L-α-methylvaline | Mtrp | L-α-methyltyrosine | Mtyr |
| L-α-methylleucine | Mval Nnbhm | L-N-methylhomophenylalanine | Nmhphe |
| N-(N-(2,2-diphenylethyl) carbamylmethyl-glycine | Nnbhm | N-(N-(3,3-diphenylpropyl) carbamylmethyl(1)glycine | Nnbhe |
| 1-carboxy-1-(2,2-diphenyl ethylamino)cyclopropane | Nmbc | | |

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab') 2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')$_2$, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11: 1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321: 522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boerner et al. are also available for the preparation of human monoclonal antibodies (Cole et al., Monoclonal Antibodies and Cancer Therapy, Alan R. Liss, p. 77 (1985) and Boerner et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10,: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radiolabelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies. Antibody binding reagents may be radiolabelled or enzyme linked as described hereinabove. Detection may be by autoradiography, calorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12; 274(4):622-34; Giebel L B et al. "Screening of cyclic peptide phage libraries identifies ligands that bind streptavidin with high affinities" Biochemistry 1995 Nov. 28; 34(47):15430-5; Davies E L et al., "Selection of specific phage-display antibodies using libraries derived from chicken immunoglobulin genes" J Immunol Methods 1995 Oct. 12; 186(1):125-35; Jones C RT al. "Current trends in molecular recognition and bioseparation" J Chromatogr A 1995 Jul. 14; 707(1):3-22; Deng S J et al. "Basis for selection of improved carbohydrate-binding single-chain antibodies from synthetic gene libraries" Proc Natl Acad Sci USA 1995 May 23; 92(11):4992-6; and Deng S J et al. "Selection of antibody single-chain variable fragments with improved carbohydrate binding by phage display" J Biol Chem 1994 Apr. 1; 269(13):9533-8, which are incorporated herein by reference.

The following sections relate to Candidate Marker Examples (first section) and to Experimental Data for these Marker Examples (second section).

Candidate Marker Examples Section

This Section relates to Examples of sequences according to the present invention, including illustrative methods of selection thereof.

Description of the methodology undertaken to uncover the biomolecular sequences of the present invention Human ESTs and cDNAs were obtained from GenBank versions 136 (Jun. 15, 2003 ftp dot ncbi dot nih dot gov/genbank/release dot notes/gb136 dot release dot notes); NCBI genome assembly of April 2003; RefSeq sequences from June 2003; Genbank version 139 (December 2003); Human Genome from NCBI (Build 34) (from October 2003); and RefSeq sequences from December 2003; and from the LifeSeq library of Incyte Corporation (ESTs only; Wilmington, Del., USA). With regard to GenBank sequences, the human EST sequences from the EST (GBEST) section and the human mRNA sequences from the primate (GBPRI) section were used; also the human nucleotide RefSeq mRNA sequences were used (see for example dot ncbi dot nlm dot nih dot gov/Genbank/GenbankOverview dot html and for a reference to the EST section, see dot ncbi dot nlm dot nih dot gov/dbEST/; a general reference to dbEST, the EST database in GenBank, may be found in Boguski et al, Nat. Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625, 545; and U.S. patent application Ser. No. 10/426,002, published as US20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1

Identification of Differentially Expressed Gene Products

Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry analysis

Library annotation—EST libraries are manually classified according to:

Tissue origin

Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.

Protocol of library construction—various methods are known in the art for library construction including normalized library construction; non-normalized library construction; subtracted libraries; ORESTES and others. It will be appreciated that at times the protocol of library construction is not indicated.

The following rules are followed:

EST libraries originating from identical biological samples are considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

Example 2

Identification of Genes Over Expressed in Cancer

Two Different Scoring Algorithms were Developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The algorithm—

Clone counting: For counting EST clones each library protocol class was given a weight based on our belief of how much the protocol reflects actual expression levels:

(i) non-normalized: 1
(ii) normalized: 0.2
(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{c+1}{C} \bigg/ \frac{n+1}{N}$$

where:

c—weighted number of "cancer" clones in the cluster.
C—weighted number of clones in all "cancer" libraries.
n—weighted number of "normal" clones in the cluster.
N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

Example 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and 2. Clones from the tissue T are at least 40% from all the clones participating in the tested cluster Fisher exact test P-values were computed both for library and weighted clone counts to check that the counts are statistically significant.

Example 4

Identification of Splice Variants Over Expressed in Cancer of Clusters which are not Over Expressed in Cancer Cancer-specific splice variants containing a unique region were identified.

Identification of unique sequence regions in splice variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:
(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:
(i) Aligned to the genome; and
(ii) Regions supported by more than 2 ESTs.

The algorithm

Each unique sequence region divides the set of transcripts into 2 groups:
(i) Transcripts containing this region (group TA).
(ii) Transcripts not containing this region (group TB).

The set of EST clones of every cluster is divided into 3 groups:
(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:
S1 is significantly enriched by cancer EST clones compared to S2; and
S1 is significantly enriched by cancer EST clones compared to cluster background (S1+S2+S3).

Identification of unique sequence regions and division of the group of transcripts accordingly is illustrated in FIG. 2. Each of these unique sequence regions corresponds to a segment, also termed herein a "node".

Region 1: common to all transcripts, thus it is not considered for detecting variants; Region 2: specific to Transcript 1; Region 3: specific to Transcripts 2 and 3; Region 4: specific to Transcript 3; Region 5: specific to Transcript 1 and 2; Region 6: specific to Transcript 1.

Example 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:
(i) 3 spliced ESTs; or
(ii) 2 spliced ESTs from 2 libraries;
(iii) 10 unspliced ESTs from 2 libraries, or
(iv) 3 libraries.

Actual Marker Examples

The following examples relate to specific actual marker examples.

Experimental Examples Section

This Section relates to Examples describing experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various cancerous and non-cancerous tissue samples. A description of the samples used in the lung cancer panel is provided in Tables 2 and 2_1, below. A description of the samples used in the normal tissue panel is provided in Tables 3 and 3_1, below. The key for Table 2_1 is provided in Table 2_1_1 below. Tests were then performed as described in the "Materials and Experimental Procedures" section below.

TABLE 2

Tissue samples in testing panel

| sample rename | Lot No. | source | pathology | Grade | gender/age |
|---|---|---|---|---|---|
| 1-B-Adeno G1 | A504117 | Biochain | Adenocarcinoma | 1 | F/29 |
| 2-B-Adeno G1 | A504118 | Biochain | Adenocarcinoma | 1 | M/64 |
| 95-B-Adeno G1 | A610063 | Biochain | Adenocarcinoma | 1 | F/54 |
| 12-B-Adeno G2 | A504119 | Biochain | Adenocarcinoma | 2 | F/74 |
| 75-B-Adeno G2 | A609217 | Biochain | Adenocarcinoma | 2 | M/65 |
| 77-B-Adeno G2 | A608301 | Biochain | Adenocarcinoma | 2 | M/44 |
| 13-B-Adeno G2-3 | A504116 | Biochain | Adenocarcinoma | 2-3 | M/64 |
| 89-B-Adeno G2-3 | A609077 | Biochain | Adenocarcinoma | 2-3 | M/62 |
| 76-B-Adeno G3 | A609218 | Biochain | Adenocarcinoma | 3 | M/57 |
| 94-B-Adeno G3 | A610118 | Biochain | Adenocarcinoma | 3 | M/68 |
| 3-CG-Adeno | CG-200 | Ichilov | Adenocarcinoma | | NA |
| 14-CG-Adeno | CG-111 | Ichilov | Adenocarcinoma | | M/68 |
| 15-CO-Bronch adeno | CG-244 | Ichilov | Bronchioloalveolar adenocarcinoma | | M/74 |
| 45-B-Alvelous Adeno | A501221 | Biochain | Alveolus carcinoma | | F/50 |
| 44-B-Alvelous Adeno G2 | A501123 | Biochain | Alveolus carcinoma | 2 2 | F/61 |
| 19-B-Squamous G1 | A408175 | Biochain | Squamous carcinoma | 1 | M/78 |
| 16-B-Squamous G2 | A409091 | Biochain | Squamous carcinoma | 2 | F/68 |
| 17-B-Squamous G2 | A503183 | Biochain | Squamous carcinoma | 2 | M/57 |

TABLE 2-continued

Tissue samples in testing panel

| sample rename | Lot No. | source | pathology | Grade | gender/age |
|---|---|---|---|---|---|
| 21-B-Squamous G2 | A503187 | Biochain | Squamous carcinoma | 2 | M/52 |
| 78-B-Squamous G2 | A607125 | Biochain | Squamous Cell Carcinoma | 2 | M/62 |
| 80-B-Squamous G2 | A609163 | Biochain | Squamous Cell Carcinoma | 2 | M/74 |
| 18-B-Squamous G2-3 | A503387 | Biochain | Squamous Cell Carcinoma | 2-3 | M/63 |
| 81-B-Squamous G3 | A609076 | Biochain | Squamous Carcinoma | 3 | m/53 |
| 79-B-Squamous G3 | A609018 | Biochain | Squamous Cell Carcinoma | 3 | M/67 |
| 20-B-Squamous | A501121 | Biochain | Squamous Carcinoma | | M/64 |
| 22-B-Squamous | A503386 | Biochain | Squamous Carcinoma | | M/48 |
| 88-B-Squamous | A609219 | Biochain | Squamous Cell Carcinoma | | M/64 |
| 100-B-Squamous | A409017 | Biochain | Squamous Carcinoma | | M/64 |
| 23-CG-Squamous | CG-109 (1) | Ichilov | Squamous Carcinoma | | M/65 |
| 24-CG-Squamous | CG-123 | Ichilov | Squamous Carcinoma | | M/76 |
| 25-CG-Squamous | CG-204 | Ichilov | Squamous Carcinoma | | M/72 |
| 87-B-Large cell G3 | A609165 | Biochain | Large Cell Carcinoma | 3 | F/47 |
| 38-B-Large cell | A504113 | Biochain | Large cell | | M/58 |
| 39-B-Large cell | A504114 | Biochain | Large cell | | F/35 |
| 82-B-Large cell | A609170 | Biochain | Large Cell Neuroendocrine Carcinoma | | M/68 |
| 30-B-Small cell carci G3 | A501389 | Biochain | small cell | 3 | M/34 |
| 31-B-Small cell carci G3 | A501390 | Biochain | small cell | 3 | F/59 |
| 32-B-Small cell carci G3 | A501391 | Biochain | small cell | 3 | M/30 |
| 33-B-Small cell carci G3 | A504115 | Biochain | small cell | 3 | M |
| 86-B-Small cell carci G3 | A608032 | Biochain | Small Cell Carcinoma | 3 | F/52 |
| 83-B-Small cell carci | A609162 | Biochain | Small Cell Carcinoma | | F/47 |
| 84-B-Small cell carci | A609167 | Biochain | Small Cell Carcinoma | | F/47 |
| 85-B-Small cell carci | A609169 | Biochain | Small Cell Carcinoma | | F/59 |
| 46-B-N M44 | A501124 | Biochain | Normal M44 | | F/61 |
| 47-B-N | A503205 | Biochain | Normal PM | | M/26 |
| 48-B-N | A503206 | Biochain | Normal PM | | M/44 |
| 49-B-N | A503384 | Biochain | Normal PM | | M/27 |
| 50-B-N | A503385 | Biochain | Normal PM | | M/28 |
| 90-B-N | A608152 | Biochain | Normal (Pool 2) PM | | pool 2 |
| 91-B-N | A607257 | Biochain | Normal (Pool 2) PM | | pool 2 |
| 92-B-N | A503204 | Biochain | Normal PM | | m/28 |
| 93-Am-N | 111P0103A | Ambion | Normal PM | | F/61 |
| 96-Am-N | 36853 | Ambion | Normal PM | | F/43 |
| 97-Am-N | 36854 | Ambion | Normal PM | | M/46 |
| 98-Am-N | 36855 | Ambion | Normal PM | | F/72 |
| 99-Am-N | 36856 | Ambion | Normal PM | | M/31 |

TABLE 2-1

Lung cancer testing panel

| Tissue | Source/ Delivery | sample name | sample id (GCI)/case id (Asterand)/ lot no. (old samples) | TISSUE ID (GCI)/ specimen ID (Asterand) | RNA ID (GCI)/ Sample ID (Asterand) | Diag | Diag remarks | Specimen location | Gr | TNM |
|---|---|---|---|---|---|---|---|---|---|---|
| LC | GCI | 1-GC-BAC-SIA | 7Z9V4 | 7Z9V4AYM | | Aden | BC | | | |

TABLE 2-1-continued

Lung cancer testing panel

| | | | | | | | | |
|---|---|---|---|---|---|---|---|---|
| LC | GCI | 2-GC-BAC-SIB | ZW2AQ | ZW2AQARP | | Aden | BC | |
| LC | Bioch | 72-(44)-Bc-BAC | A501123 | | | AC | 2 | UN |
| LC | Bioch | 73-(45)-Bc-BAC | A501221 | | | AC | UN | UN |
| LC | GCI | 4-GC-Adeno-SIA | 3MOPL | 3MOPLA79 | | Aden | | |
| LC | GCI | 5-GC-Adeno-SIA | KOJXD | KOJXDAV4 | | Aden | | |
| LC | GCI | 6-GC-Adeno-SIA | X2Q44 | X2Q44A79 | | Aden | | |
| LC | GCI | 7-GC-Adeno-SIA | 6BACZ | 6BACZAP5 | | Aden | | |
| LC | GCI | 8-GC-Adeno-SIA | BS9AF | BS9AFA3E | | Aden | | |
| LC | GCI | 9-GC-Adeno-SIA | UCLOA | UCLOAA9L | | Aden | | |
| LC | GCI | 10-GC-Adeno-SIA | BVYK3 | BVYK3A7Z | | Aden | | |
| LC | GCI | 11-GC-Adeno-SIB | U4DM4 | U4DM4AFZ | | Aden | | |
| LC | GCI | 12-GC-Adeno-SIB | OWX5Y | OWX5YA3S | | Aden | | |
| LC | GCI | 13-GC-Adeno-SIIA | XYY96 | XYY96A6B | | Aden | | |
| LC | GCI | 14-GC-Adeno-SIIA | SO7B1 | SO7B1AIJ | | Aden | | |
| LC | GCI | 15-GC-Adeno-SIIIA | QANSY | QANSYACD | | Aden | | |
| LC | Bioch | 16-(95)-BC-Adeno | A610063 | | | Aden | 1 | UN |
| LC | Bioch | 17-(89)-Bc-Adeno | A609077 | | | Aden | 2-3 | UN |
| LC | Bioch | 18-(76)-Bc-Adeno | A609218 | | | Aden | 3 | UN |
| LC | Bioch | 74-(2)-Bc-Adeno | A504118 | | | Aden | 1 | UN |
| LC | Bioch | 76-(75)-Bc-Adeno | A609217 | | | Aden | 2 | UN |
| LC | Bioch | 77-(12)-Bc-Adeno | A504119 | | | Aden | 2 | UN |
| LC | Bioch | 78-(13)-Bc-Adeno | A504116 | | | Aden | 2-3 | UN |
| LC | Bioch | 79-(94)-Bc-Adeno | A610118 | | | Aden | 3 | UN |
| LC | Ichilov | 80-(3)-Ic-Adeno | CG-200 | | | Aden | UN | UN |
| LC | Ichilov | 81-(14)-Ic-Adeno | CG-111 | | | Aden | UN | UN |
| LC | Aster | 19-As-Sq-S0 | 9220 | 9418 | 9418A1 | SQ | 1 | TXN0M0 |
| LC | GCI | 20-GC-Sq-SIA | U2QHS | U2QHSA2N | | SQ | | |
| LC | GCI | 21-GC-Sq-SIB | TRQR7 | TRQR7ACD | | SQ | | |
| LC | Aster | 22-As-Sq-SIB | 17581 | 32603 | 32603B1 | SQ | 3 | T2N0M0 |
| LC | Aster | 23-As-Sq-SIB | 18309 | 41454 | 41454B1 | SQ | 2 | T2N0MX |
| LC | Aster | 24-As-Sq-SIB | 9217 | 9415 | 9415B1 | SQ | 2 | T2N0M0 |
| LC | GCI | 25-GC-Sq-SIIB | RXQ1P | RXQ1PAEA | | SQ | | |
| LC | GCI | 26-GC-Sq-SIIB | KB5KH | KB5KHA6X | | SQ | | |
| LC | GCI | 27-GC-Sq-SIIIA | LAYMB | LAYMBALF | | SQ | | |
| LC | Ichilov | 28-(23)-Ic-Sq | CG-109 (1) | | | SQ | UN | UN |
| LC | Ichilov | 29-(25)-Ic-Sq | CG-204 | | | SQ | UN | UN |
| LC | Bioch | 30-(19)-Bc-Sq | A408175 | | | SQ | 1 | UN |
| LC | Bioch | 31-(78)-Bc-Sq | A607125 | | | SQ | 2 | UN |
| LC | Bioch | 32-(16)-Bc-Sq | A409091 | | | SQ | 2 | UN |
| LC | Bioch | 33-(80)-Bc-Sq | A609163 | | | SQ | 2 | UN |
| LC | Bioch | 34-(18)-Bc-Sq | A503387 | | | SQ | 2-3 | UN |
| LC | Bioch | 35-(81)-Bc-Sq | A609076 | | | SQ | 3 | UN |
| LC | Bioch | 82-(21)-Bc-Sq | A503187 | | | SQ | 2 | UN |
| LC | Bioch | 83-(17)-Bc-Sq | A503183 | | | SQ | 2 | UN |
| LC | Bioch | 84-(79)-Bc-Sq | A609018 | | | SQ | 3 | UN |
| LC | Bioch | 85-(22)-Bc-Sq | A503386 | | | SQ | UN | UN |
| LC | Bioch | 86-(20)-Bc-Sq | A501121 | | | SQ | UN | UN |
| LC | Bioch | 87-(88)-Bc-Sq | A609219 | | | SQ | UN | UN |
| LC | Bioch | 88-(100)-Bc-Sq | A409017 | | | SQ | UN | UN |
| LC | Ichilov | 89-(24)-Ic-Sq | CG-123 | | | SQ | UN | UN |
| LC | GCI | 36-GC-LCC-SIA | AF8AL | AF8ALAAL | | LCC | | |

TABLE 2-1-continued

| | | | | Lung cancer testing panel | | | | | | | |
|---|---|---|---|---|---|---|---|---|---|---|---|
| LC | GCI | 37-GC-LCC-SIB | O62XU | O62XUA1X | LCC | | | | | | |
| LC | GCI | 38-GC-LCC-SIB | OLOIM | OLOIMAS1 | LCC | | | | | | |
| LC | GCI | 39-GC-LCC-SIIB | 1ZWSV | 1ZWSVAB9 | LCC | | | | | | |
| LC | GCI | 40-GC-LCC-SIIB | 2YHOD | 2YHODA1H | LCC | NSCC . . . | | | | | |
| LC | GCI | 41-GC-LCC-SIIB | 38B4D | 38B4DAQK | LCC | | | | | | |
| LC | Bioch | 90-(39)-Bc-LCC | A504114 | | LCC | | | | | UN | UN |
| LC | Bioch | 91-(87)-Bc-LCC | A609165 | | LCC | | | | | 3 | UN |
| LC | Bioch | 92-(38)-Bc-LCC | A504113 | | LCC | | | | | UN | UN |
| LC | Bioch | 93-(82)-Bc-LCC | A609170 | | LCNC | | | | | UN | UN |
| LC | GCI | 42-GC-SCC-SIB | QPJQL | QPJQLAF6 | SCC | NC | | | | 3 | |
| LC | Bioch | 43-(32)-Bc-SCC | A501391 | | SCC | | | | | | UN |
| LC | Bioch | 44-(30)-Bc-SCC | A501389 | | SCC | | | | | 3 | |
| LC | Bioch | 45-(83)-Bc-SCC | A609162 | | SCC | | | | | UN | UN |
| LC | Bioch | 46-(86)-Bc-SCC | A608032 | | SCC | | | | | 3 | |
| LC | Bioch | 47-(31)-Bc-SCC | A501390 | | SCC | | | | | | UN |
| LC | Bioch | 48-(84)-Bc-SCC | A609167 | | SCC | | | | | UN | UN |
| LC | Bioch | 49-(85)-Bc-SCC | A609169 | | SCC | | | | | UN | UN |
| LC | Bioch | 50-(33)-Bc-SCC | A504115 | | SCC | | | | | | UN |
| LN | Aster | 51-As-N-PS | 9078 | 9275 | 9275B1 | Norm-L | PS | | | | |
| LN | Aster | 52-As-N-PM | 8757 | 8100 | 8100B1 | Norm-L | PM | (Right), Lobe Inferior | | | |
| LN | Aster | 53-As-N-PM | 6692 | 6161 | 6161A1 | Norm-L | PM | | | | |
| LN | Aster | 54-As-N-PM | 7900 | 7180 | 7180F1 | Norm-L | PM | | | | |
| LN | Aster | 55-As-N-PM | 8771 | 8163 | 8163A1 | Norm-L | PM | (Left), Lobe Superior | | | |
| LN | Aster | 56-As-N-PM | 13094 | 19763 | 19763A1 | Norm-L | PM | | | | |
| LN | Aster | 57-As-N-PM | 19174 | 40654 | 40654A2 | Norm-L | PM | | | | |
| LN | Aster | 58-As-N-PM | 13128 | 19642 | 19642A1 | Norm-L | PM | | | | |
| LN | Aster | 59-As-N-PM | 14374 | 20548 | 20548C1 | Norm-L | PM | (Right), Lobe Superior | | | |
| LN | Amb | 60-(99)-Am-N PM | 36856 | | | N-PM | PM | | | | |
| LN | Amb | 61-(96)-Am-N PM | 36853 | | | N-PM | PM | | | | |
| LN | Amb | 62-(97)-Am-N PM | 36854 | | | N-PM | PM | | | | |
| LN | Amb | 63-(93)-Am-N PM | 111P0103A | | | N-PM | PM-ICH | | | | |
| LN | Amb | 64-(98)-Am-N PM | 36855 | | | N-PM | PM | | | | |
| LN | Bioch | 67-(50)-Bc-N PM | A503385 | | | N-PM | PM | | | | |
| LN | Bioch | 68-(92)-Bc-N PM | A503204 | | | N-PM | PM | | | | |
| LN | Bioch | 69-(91)-Bc-N PM | A607257 | | | N-P2-PM | PM | | | | |
| LN | Bioch | 70-(90)-Bc-N PM | A608152 | | | N-P2-PM | PM | | | | |
| LN | Bioch | 71-(48)-Bc-N PM | A503206 | | | N-PM | PM | | | | |

| Tissue | Source/Delivery | sample name | CS | Tum % | Gen | age | Ethnic B | Smoking Status | # Cig. Per day | # of Y. Use of Tobacco |
|---|---|---|---|---|---|---|---|---|---|---|
| LC | GCI | 1-GC-BAC-SIA | IA | 80 | F | 63 | WCAU | Prev U. | 20 | 15 |

TABLE 2-1-continued

| | | | Lung cancer testing panel | | | | | | | |
|---|---|---|---|---|---|---|---|---|---|---|
| LC | GCI | 2-GC-BAC-SIB | IB | 70 | F | 56 | WCAU | Prev U. | 15 | 28 |
| LC | Bioch | 72-(44)-Bc-BAC | | | F | 61 | | | | |
| LC | Bioch | 73-(45)-Bc-BAC | | | F | 50 | | | | |
| LC | GCI | 4-GC-Adeno-SIA | IA | 60 | M | 68 | WCAU | Nev U. | — | — |
| LC | GCI | 5-GC-Adeno-SIA | IA | 90 | F | 64 | WCAU | Prev U. | 15 | 40 |
| LC | GCI | 6-GC-Adeno-SIA | IA | 85 | M | 58 | WCAU | Prev U. | 10 | 47 |
| LC | GCI | 7-GC-Adeno-SIA | IA | 60 | F | 65 | WCAU | Curr U. | 6 | 30 |
| LC | GCI | 8-GC-Adeno-SIA | IA | 55 | F | 59 | WCAU | Curr U. | 20 | 40 |
| LC | GCI | 9-GC-Adeno-SIA | IA | 80 | F | 69 | WCAU | Curr U. | 30 | 52 |
| LC | GCI | 10-GC-Adeno-SIA | IA | 60 | F | 60 | WCAU | Curr U. | 40 | 40 |
| LC | GCI | 11-GC-Adeno-SIB | IB | 65 | F | 68 | WCAU | Prev U. | 5 | 4 |
| LC | GCI | 12-GC-Adeno-SIB | IB | 90 | M | 69 | WCAU | Curr U. | 10 | — |
| LC | GCI | 13-GC-Adeno-SIIA | IIA | 70 | F | 62 | WCAU | Prev U. | 6 | 40 |
| LC | GCI | 14-GC-Adeno-SIIA | IIA | 70 | M | 56 | WCAU | Curr U. | 30 | 25 |
| LC | GCI | 15-GC-Adeno-SIIIA | IIIA | 65 | F | 61 | WCAU | Curr U. | 30 | 36 |
| LC | Bioch | 16-(95)-BC-Adeno | | | F | 54 | | | | |
| LC | Bioch | 17-(89)-Bc-Adeno | | | M | 62 | | | | |
| LC | Bioch | 18-(76)-Bc-Adeno | | | M | 57 | | | | |
| LC | Bioch | 74-(2)-Bc-Adeno | | | M | 64 | | | | |
| LC | Bioch | 76-(75)-Bc-Adeno | | | M | 65 | | | | |
| LC | Bioch | 77-(12)-Bc-Adeno | | | F | 74 | | | | |
| LC | Bioch | 78-(13)-Bc-Adeno | | | M | 64 | | | | |
| LC | Bioch | 79-(94)-Bc-Adeno | | | M | 68 | | | | |
| LC | Ichilov | 80-(3)-Ic-Adeno | | | F | 56 | | | | |
| LC | Ichilov | 81-(14)-Ic-Adeno | | | M | 68 | | | | |
| LC | Aster | 19-As-Sq-S0 | Occult | 80 | M | 67 | CAU | Curr U. | 11-20 | 31-40 |
| LC | GCI | 20-GC-Sq-SIA | IA | 55 | F | 68 | WCAU | Prev U. | 10 | 20 |
| LC | GCI | 21-GC-Sq-SIB | IB | 75 | M | 62 | WCAU | Prev U. | 20 | 50 |
| LC | Aster | 22-As-Sq-SIB | IB | 90 | M | 73 | CAU | Prev U. | | |
| LC | Aster | 23-As-Sq-SIB | IB | 100 | M | 66 | CAU | Prev U. | 11-20 | 45 |
| LC | Aster | 24-As-Sq-SIB | IB | 90 | M | 65 | CAU | Curr U. | 6-10 | 41-50 |
| LC | GCI | 25-GC-Sq-SIIB | IIB | 55 | F | 44 | WCAU | Prev U. | 20 | 20 |
| LC | GCI | 26-GC-Sq-SIIB | IIB | 65 | M | 68 | WCAU | Prev U. | 40 | 40 |
| LC | GCI | 27-GC-Sq-SIIIA | IIIA | 65 | F | 58 | WCAU | Prev U. | 50 | 40 |
| LC | Ichilov | 28-(23)-Ic-Sq | | | M | 65 | | | | |
| LC | Ichilov | 29-(25)-Ic-Sq | | | M | 72 | | | | |
| LC | Bioch | 30-(19)-Bc-Sq | | | M | 78 | | | | |
| LC | Bioch | 31-(78)-Bc-Sq | | | M | 62 | | | | |
| LC | Bioch | 32-(16)-Bc-Sq | | | F | 68 | | | | |
| LC | Bioch | 33-(80)-Bc-Sq | | | M | 74 | | | | |
| LC | Bioch | 34-(18)-Bc-Sq | | | M | 63 | | | | |
| LC | Bioch | 35-(81)-Bc-Sq | | | M | 53 | | | | |
| LC | Bioch | 82-(21)-Bc-Sq | | | M | 52 | | | | |
| LC | Bioch | 83-(17)-Bc-Sq | | | M | 57 | | | | |
| LC | Bioch | 84-(79)-Bc-Sq | | | M | 67 | | | | |
| LC | Bioch | 85-(22)-Bc-Sq | | | M | 48 | | | | |
| LC | Bioch | 86-(20)-Bc-Sq | | | M | 64 | | | | |
| LC | Bioch | 87-(88)-Bc-Sq | | | M | 64 | | | | |
| LC | Bioch | 88-(100)-Bc-Sq | | | M | 64 | | | | |
| LC | Ichilov | 89-(24)-Ic-Sq | | | M | 76 | | | | |
| LC | GCI | 36-GC-LCC-SIA | IA | 85 | M | 45 | WCAU | Prev U. | 45 | 33 |

TABLE 2-1-continued

Lung cancer testing panel

| | | | | | | | | | | |
|---|---|---|---|---|---|---|---|---|---|---|
| LC | GCI | 37-GC-LCC-SIB | IB | 75 | F | 60 | WCAU | Prev U. | 30 | 45 |
| LC | GCI | 38-GC-LCC-SIB | IB | 70 | M | 68 | WCAU | Prev U. | — | 55 |
| LC | GCI | 39-GC-LCC-SIIB | IIB | 50 | M | 51 | WCAU | Prev U. | 20 | 12 |
| LC | GCI | 40-GC-LCC-SIIB | IIB | 95 | M | 62 | WCAU | Prev U. | 40 | 40 |
| LC | GCI | 41-GC-LCC-SIIB | IIB | 90 | F | 70 | WCAU | Prev U. | 30 | 50 |
| LC | Bioch | 90-(39)-Bc-LCC | | | F | 35 | | | | |
| LC | Bioch | 91-(87)-Bc-LCC | | | F | 47 | | | | |
| LC | Bioch | 92-(38)-Bc-LCC | | | M | 58 | | | | |
| LC | Bioch | 93-(82)-Bc-LCC | | | M | 68 | | | | |
| LC | GCI | 42-GC-SCC-SIB | IB | 65 | F | 62 | WCAU | Prev U. | 20 | 35 |
| LC | Bioch | 43-(32)-Bc-SCC | | | M | 30 | | | | |
| LC | Bioch | 44-(30)-Bc-SCC | | | M | 34 | | | | |
| LC | Bioch | 45-(83)-Bc-SCC | | | F | 47 | | | | |
| LC | Bioch | 46-(86)-Bc-SCC | | | F | 52 | | | | |
| LC | Bioch | 47-(31)-Bc-SCC | | | F | 59 | | | | |
| LC | Bioch | 48-(84)-Bc-SCC | | | F | 59 | | | | |
| LC | Bioch | 49-(85)-Bc-SCC | | | M | 66 | | | | |
| LC | Bioch | 50-(33)-Bc-SCC | | | M | | | | | |
| LN | Aster | 51-As-N-PS | | | M | 22 | CAU | Nev U. | | |
| LN | Aster | 52-As-N-PM | | | F | 26 | CAU | Nev U. | | |
| LN | Aster | 53-As-N-PM | | | M | 37 | CAU | Nev U. | | |
| LN | Aster | 54-As-N-PM | | | F | 76 | CAU | Prev U. | | |
| LN | Aster | 55-As-N-PM | | | M | 81 | CAU | Prev U. | 41 or more | 31-40 |
| LN | Aster | 56-As-N-PM | | | M | 0 | CAU | Prev U. | 21-40 | 41-50 |
| LN | Aster | 57-As-N-PM | | | F | 69 | CAU | Curr U. | 21-40 | 31-40 |
| LN | Aster | 58-As-N-PM | | | F | 75 | CAU | | | |
| LN | Aster | 59-As-N-PM | | | F | 75 | CAU | | | |
| LN | Amb | 60-(99)-Am-N PM | | | M | 31 | | | | |
| LN | Amb | 61-(96)-Am-N PM | | | F | 43 | | | | |
| LN | Amb | 62-(97)-Am-N PM | | | M | 46 | | | | |
| LN | Amb | 63-(93)-Am-N PM | | | F | 61 | | | | |
| LN | Amb | 64-(98)-Am-N PM | | | F | 72 | | | | |
| LN | Bioch | 67-(50)-Bc-N PM | | | M | 28 | | | | |
| LN | Bioch | 68-(92)-Bc-N PM | | | M | 28 | | | | |
| LN | Bioch | 69-(91)-Bc-N PM | | | P2 | 24, 29 | | | | |
| LN | Bioch | 70-(90)-Bc-N PM | | | P2 | 27, 28 | | | | |
| LN | Bioch | 71-(48)-Bc-N PM | | | M | 44 | | | | |

| Tissue | Source/Delivery | sample name | # Y. off Tobacco | Sm P Y? | Sm ppl | Dr Al | # Dr | Recovery Type | Cause of Death | Exc. Y. |
|---|---|---|---|---|---|---|---|---|---|---|
| LC | GCI | 1-GC-BAC-SIA | 27 | N | — | Y | 0 | Surg | | 2001 |
| LC | GCI | 2-GC-BAC-SIB | 10 | Y | 1 | Y | 6 | Surg | | 2002 |
| LC | Bioch | 72-(44)-Bc-BAC | | | | | | | | |
| LC | Bioch | 73-(45)-Bc-BAC | | | | | | | | |

TABLE 2-1-continued

Lung cancer testing panel

| LC | GCI | 4-GC-Adeno-SIA | — | N | — | N | — | Surg | 2001 |
|----|-----|----------------|---|---|---|---|---|------|------|
| LC | GCI | 5-GC-Adeno-SIA | 7 | Y | 1 | N | 0 | Surg | 2003 |
| LC | GCI | 6-GC-Adeno-SIA | 0 | Y | 2 | N | — | Surg | 2004 |
| LC | GCI | 7-GC-Adeno-SIA | — | Y | 1 | N | — | Surg | 2004 |
| LC | GCI | 8-GC-Adeno-SIA | — | N | — | N | — | Surg | 2004 |
| LC | GCI | 9-GC-Adeno-SIA | — | Y | 4 | N | — | Surg | 2005 |
| LC | GCI | 10-GC-Adeno-SIA | — | N | — | N | — | Surg | 2002 |
| LC | GCI | 11-GC-Adeno-SIB | 43 | N | — | N | — | Surg | 2003 |
| LC | GCI | 12-GC-Adeno-SIB | — | | — | N | — | Surg | 2002 |
| LC | GCI | 13-GC-Adeno-SIIA | 6 | N | — | Y | 0 | Surg | 2004 |
| LC | GCI | 14-GC-Adeno-SIIA | — | Y | 1 | N | — | Surg | 2001 |
| LC | GCI | 15-GC-Adeno-SIIIA | — | Y | 1 | N | — | Surg | 2004 |
| LC | Bioch | 16-(95)-BC-Adeno | | | | | | | |
| LC | Bioch | 17-(89)-Bc-Adeno | | | | | | | |
| LC | Bioch | 18-(76)-Bc-Adeno | | | | | | | |
| LC | Bioch | 74-(2)-Bc-Adeno | | | | | | | |
| LC | Bioch | 76-(75)-Bc-Adeno | | | | | | | |
| LC | Bioch | 77-(12)-Bc-Adeno | | | | | | | |
| LC | Bioch | 78-(13)-Bc-Adeno | | | | | | | |
| LC | Bioch | 79-(94)-Bc-Adeno | | | | | | | |
| LC | Ichilov | 80-(3)-Ic-Adeno | | | | | | | |
| LC | Ichilov | 81-(14)-Ic-Adeno | | | | | | | |
| LC | Aster | 19-As-Sq-S0 | | | | O | | Surg | 2003 |
| LC | GCI | 20-GC-Sq-SIA | 0 | N | — | N | — | Surg | 2004 |
| LC | GCI | 21-GC-Sq-SIB | 0 | Y | 5 | N | — | Surg | 2005 |
| LC | Aster | 22-As-Sq-SIB | | | | O | | Surg | 2004 |
| LC | Aster | 23-As-Sq-SIB | | | | P | | Surg | 2005 |
| LC | Aster | 24-As-Sq-SIB | | | | O | | Surg | 2002 |
| LC | GCI | 25-GC-Sq-SIIB | 0 | Y | 2 | N | — | Surg | 2004 |
| LC | GCI | 26-GC-Sq-SIIB | 0 | Y | 2 | N | — | Surg | 2004 |
| LC | GCI | 27-GC-Sq-SIIIA | 1 | Y | 2 | N | — | Surg | 2004 |
| LC | Ichilov | 28-(23)-Ic-Sq | | | | | | | |
| LC | Ichilov | 29-(25)-Ic-Sq | | | | | | | |
| LC | Bioch | 30-(19)-Bc-Sq | | | | | | | |
| LC | Bioch | 31-(78)-Bc-Sq | | | | | | | |
| LC | Bioch | 32-(16)-Bc-Sq | | | | | | | |
| LC | Bioch | 33-(80)-Bc-Sq | | | | | | | |
| LC | Bioch | 34-(18)-Bc-Sq | | | | | | | |
| LC | Bioch | 35-(81)-Bc-Sq | | | | | | | |
| LC | Bioch | 82-(21)-Bc-Sq | | | | | | | |
| LC | Bioch | 83-(17)-Bc-Sq | | | | | | | |
| LC | Bioch | 84-(79)-Bc-Sq | | | | | | | |
| LC | Bioch | 85-(22)-Bc-Sq | | | | | | | |
| LC | Bioch | 86-(20)-Bc-Sq | | | | | | | |
| LC | Bioch | 87-(88)-Bc-Sq | | | | | | | |
| LC | Bioch | 88-(100)-Bc-Sq | | | | | | | |
| LC | Ichilov | 89-(24)-Ic-Sq | | | | | | | |
| LC | GCI | 36-GC-LCC-SIA | 0 | Y | 2 | Y | 28 | Surg | 2004 |
| LC | GCI | 37-GC-LCC-SIB | 0 | Y | 3 | N | — | Surg | 2004 |
| LC | GCI | 38-GC-LCC-SIB | — | Y | — | N | — | Surg | 2001 |
| LC | GCI | 39-GC-LCC-SIIB | 22 | Y | 1 | N | — | Surg | 2004 |

TABLE 2-1-continued

| | | | | Lung cancer testing panel | | | | | | | |
|---|---|---|---|---|---|---|---|---|---|---|---|
| LC | GCI | 40-GC-LCC-SIIB | 0 | | Y | 2 | Y | 12 | Surg | | 2004 |
| LC | GCI | 41-GC-LCC-SIIB | — | | Y | 2 | Y | 13 | Surg | | 2002 |
| LC | Bioch | 90-(39)-Bc-LCC | | | | | | | | | |
| LC | Bioch | 91-(87)-Bc-LCC | | | | | | | | | |
| LC | Bioch | 92-(38)-Bc-LCC | | | | | | | | | |
| LC | Bioch | 93-(82)-Bc-LCC | | | | | | | | | |
| LC | GCI | 42-GC-SCC-SIB | 0.15 | | Y | 2 | N | — | Surg | | 2003 |
| LC | Bioch | 43-(32)-Bc-SCC | | | | | | | | | |
| LC | Bioch | 44-(30)-Bc-SCC | | | | | | | | | |
| LC | Bioch | 45-(83)-Bc-SCC | | | | | | | | | |
| LC | Bioch | 46-(86)-Bc-SCC | | | | | | | | | |
| LC | Bioch | 47-(31)-Bc-SCC | | | | | | | | | |
| LC | Bioch | 48-(84)-Bc-SCC | | | | | | | | | |
| LC | Bioch | 49-(85)-Bc-SCC | | | | | | | | | |
| LC | Bioch | 50-(33)-Bc-SCC | | | | | | | | | |
| LN | Aster | 51-As-N-PS | | | | | | NU | Surg | | 2003 |
| LN | Aster | 52-As-N-PM | | | | | | O | Aut | CA | 2003 |
| LN | Aster | 53-As-N-PM | | | | | | C | Aut | MCE | 2002 |
| LN | Aster | 54-As-N-PM | | | | | | | Aut | CPulA | 2002 |
| LN | Aster | 55-As-N-PM | | | | | | O | Aut | CA | 2003 |
| LN | Aster | 56-As-N-PM | | | | | | P | Aut | IC | |
| LN | Aster | 57-As-N-PM | | | | | | P | Aut | CPulA | 2005 |
| LN | Aster | 58-As-N-PM | | | | | | | Aut | CPulA | 2004 |
| LN | Aster | 59-As-N-PM | | | | | | | Aut | CerA | 2004 |
| LN | Amb | 60-(99)-Am-N PM | | | | | | | | | |
| LN | Amb | 61-(96)-Am-N PM | | | | | | | | | |
| LN | Amb | 62-(97)-Am-N PM | | | | | | | | | |
| LN | Amb | 63-(93)-Am-N PM | | | | | | | | | |
| LN | Amb | 64-(98)-Am-N PM | | | | | | | | | |
| LN | Bioch | 67-(50)-Bc-N PM | | | | | | | | | |
| LN | Bioch | 68-(92)-Bc-N PM | | | | | | | | | |
| LN | Bioch | 69-(91)-Bc-N PM | | | | | | | | | |
| LN | Bioch | 70-(90)-Bc-N PM | | | | | | | | | |
| LN | Bioch | 71-(48)-Bc-N PM | | | | | | | | | |

| Key | Full Name | Key | Full Name |
|---|---|---|---|
| # Cig. Per day | Number of Cigarettes per day | Bioch | Biochain |
| # Dr | Number of Drinks | C | Current Use |
| # of Y. Use of Tobacco | Number of Years Using Tobacco | CA | Cardiac arrest |
| # Y. off Tobacco | Number of Years Off Tobacco | CAU | Caucasian |
| AC | Alveolus carcinoma | Cer A | Cerebrovascular accident |
| Aden | ADENOCARCINOMA | CPul A | Cardiopulmonary arrest |
| Amb | Ambion | CS | Cancer Stage |
| Aster | Asterand | Curr U. | Current Use |
| Aut | Autopsy | Diag | Diagnosis |
| BC | BRONCHIOLOALVEOLAR CARCINOMA | Dr Al | Drink Alcohol? |

-continued

| Key | Full Name |
|---|---|
| Exc Y. | Excision Year |
| Gen | Gender |
| Gr | Grade |
| Height | HT |
| IC | Ischemic cardiomyopathy |
| LC | Lung Cancer |
| LCC | LARGE CELL CARCINOMA |
| LCNC | Large Cell Neuroendocrine Carcinoma |
| LN | Lung Normal |
| MCE | Massive cerebral edema |
| N | No |
| NC | NEUROENDOCRINE CARCINOMA |
| Nev. U. | Never Used |
| Norm-L | Normal Lung |
| N-P2-PM | Normal (Pool 2)-PM |
| N-PM | Normal-PM |

-continued

| Key | Full Name |
|---|---|
| NSCC . . . | NON-SMALL CELL CARCINOMA WITH SARCOMUTOUS TRANSFORMTAIO |
| NU | Never used |
| O | Occasional Use |
| P | Previous Use |
| P2 | Pool 2 |
| Prev U. | Previous Use |
| SQ | Squamous Cell Carcinoma |
| Sm P Y? | Have people at home smoked in past 15 yr |
| Sm ppl | If yes, how many? |
| SCC | SMALL CELL CARCINOMA |
| SMOKE_GROWING_UP | Did people smoke at home while growing up |
| Surg | Surgical |
| Tum % | Tumor Percentage |
| WCAU | White Caucasian |
| Y | Yes |

TABLE 3

Tissue samples in normal panel:

| | Lot no. | Source | Tissue | Pathology | Sex/Age |
|---|---|---|---|---|---|
| 1-Am-Colon (C71) | 071P10B | Ambion | Colon | PM | F/43 |
| 2-B-Colon (C69) | A411078 | Biochain | Colon | PM-Pool of 10 | M&F |
| 3-Cl-Colon (C70) | 1110101 | Clontech | Colon | PM-Pool of 3 | M&F |
| 4-Am-Small Intestine | 091P0201A | Ambion | Small Intestine | PM | M/75 |
| 5-B-Small Intestine | A501158 | Biochain | Small Intestine | PM | M/63 |
| 6-B-Rectum | A605138 | Biochain | Rectum | PM | M/25 |
| 7-B-Rectum | A610297 | Biochain | Rectum | PM | M/24 |
| 8-B-Rectum | A610298 | Biochain | Rectum | PM | M/27 |
| 9-Am-Stomach | 110P04A | Ambion | Stomach | PM | M/16 |
| 10-B-Stomach | A501159 | Biochain | Stomach | PM | M/24 |
| 11-B-Esophagus | A603814 | Biochain | Esophagus | PM | M/26 |
| 12-B-Esophagus | A603813 | Biochain | Esophagus | PM | M/41 |
| 13-Am-Pancreas | 071P25C | Ambion | Pancreas | PM | M/25 |
| 14-CG-Pancreas | CG-255-2 | Ichilov | Pancreas | PM | M/75 |
| 15-B-Lung | A409363 | Biochain | Lung | PM | F/26 |
| 16-Am-Lung (L93) | 111P0103A | Ambion | Lung | PM | F/61 |
| 17-B-Lung (L92) | A503204 | Biochain | Lung | PM | M/28 |
| 18-Am-Ovary (O47) | 061P43A | Ambion | Ovary | PM | F/16 |
| 19-B-Ovary (O48) | A504087 | Biochain | Ovary | PM | F/51 |
| 20-B-Ovary (O46) | A504086 | Biochain | Ovary | PM | F/41 |
| 21-Am-Cervix | 101P0101A | Ambion | Cervix | PM | F/40 |
| 22-B-Cervix | A408211 | Biochain | Cervix | PM | F/36 |
| 23-B-Cervix | A504089 | Biochain | Cervix | PM-Pool of 5 | M&F |
| 24-B-Uterus | A411074 | Biochain | Uterus | PM-Pool of 10 | M&F |
| 25-B-Uterus | A409248 | Biochain | Uterus | PM | F/43 |
| 26-B-Uterus | A504090 | Biochain | Uterus | PM-Pool of 5 | M&F |
| 27-B-Bladder | A501157 | Biochain | Bladder | PM | M/29 |
| 28-Am-Bladder | 071P02C | Ambion | Bladder | PM | M/20 |
| 29-B-Bladder | A504088 | Biochain | Bladder | PM-Pool of 5 | M&F |
| 30-Am-Placenta | 021P33A | Ambion | Placenta | PB | F/33 |
| 31-B-Placenta | A410165 | Biochain | Placenta | PB | F/26 |
| 32-B-Placenta | A411073 | Biochain | Placenta | PB-Pool of 5 | M&F |
| 33-B-Breast (B59) | A607155 | Biochain | Breast | PM | F/36 |
| 34-Am-Breast (B63) | 26486 | Ambion | Breast | PM | F/43 |
| 35-Am-Breast (B64) | 23036 | Ambion | Breast | PM | F/57 |
| 36-Cl-Prostate (P53) | 1070317 | Clontech | Prostate | PB-Pool of 47 | M&F |
| 37-Am-Prostate (P42) | 061P04A | Ambion | Prostate | PM | M/47 |
| 38-Am-Prostate (P59) | 25955 | Ambion | Prostate | PM | M/62 |
| 39-Am-Testis | 111P0104A | Ambion | Testis | PM | M/25 |
| 40-B-Testis | A411147 | Biochain | Testis | PM | M/74 |
| 41-Cl-Testis | 1110320 | Clontech | Testis | PB-Pool of 45 | M&F |
| 42-CG-Adrenal | CG-184-10 | Ichilov | Adrenal | PM | F/81 |
| 43-B-Adrenal | A610374 | Biochain | Adrenal | PM | F/83 |
| 44-B-Heart | A411077 | Biochain | Heart | PB-Pool of 5 | M&F |
| 45-CG-Heart | CG-255-9 | Ichilov | Heart | PM | M/75 |
| 46-CG-Heart | CG-227-1 | Ichilov | Heart | PM | F/36 |
| 47-Am-Liver | 081P0101A | Ambion | Liver | PM | M/64 |
| 48-CG-Liver | GG-93-3 | Ichilov | Liver | PM | F/19 |
| 49-CG-Liver | CG-124-4 | Ichilov | Liver | PM | F/34 |
| 50-Cl-BM | 1110932 | Clontech | Bone Marrow | PM-Pool of 8 | M&F |

TABLE 3-continued

Tissue samples in normal panel:

| | Lot no. | Source | Tissue | Pathology | Sex/Age |
|---|---|---|---|---|---|
| 51-CGEN-Blood | WBC#5 | CGEN | Blood | | M |
| 52-CGEN-Blood | WBC#4 | CGEN | Blood | | M |
| 53-CGEN-Blood | WBC#3 | CGEN | Blood | | M |
| 54-CG-Spleen | CG-267 | Ichilov | Spleen | PM | F/25 |
| 55-CG-Spleen | 111P0106B | Ambion | Spleen | PM | M/25 |
| 56-CG-Spleen | A409246 | Biochain | Spleen | PM | F/12 |
| 56-CG-Thymus | CG-98-7 | Ichilov | Thymus | PM | F/28 |
| 58-Am-Thymus | 101P0101A | Ambion | Thymus | PM | M/14 |
| 59-B-Thymus | A409278 | Biochain | Thymus | PM | M/28 |
| 60-B-Thyroid | A610287 | Biochain | Thyroid | PM | M/27 |
| 61-B-Thyroid | A610286 | Biochain | Thyroid | PM | M/24 |
| 62-CG-Thyroid | CG-119-2 | Ichilov | Thyroid | PM | F/66 |
| 63-Cl-Salivary Gland | 1070319 | Clontech | Salivary Gland | PM-Pool of 24 | M&F |
| 64-Am-Kidney | 111P0101B | Ambion | Kidney | PM-Pool of 14 | M&F |
| 65-Cl-Kidney | 1110970 | Clontech | Kidney | PM-Pool of 14 | M&F |
| 66-B-Kidney | A411080 | Biochain | Kidney | PM-Pool of 5 | M&F |
| 67-CG-Cerebellum | CG-183-5 | Ichilov | Cerebellum | PM | M/74 |
| 68-CG-Cerebellum | CG-212-5 | Ichilov | Cerebellum | PM | M/54 |
| 69-B-Brain | A411322 | Biochain | Brain | PM | M/28 |
| 70-Cl-Brain | 1120022 | Clontech | Brain | PM-Pool of 2 | M&F |
| 71-B-Brain | A411079 | Biochain | Brain | PM-Pool of 2 | M&F |
| 72-CG-Brain | CG-151-1 | Ichilov | Brain | PM | F/86 |
| 73-Am-Skeletal Muscle | 101P013A | Ambion | Skeletal Muscle | PM | F/28 |
| 74-Cl-Skeletal Muscle | 1061038 | Clontech | Skeletal Muscle | PM-Pool of 29 | M&F |

TABLE 3_1

| old sample name | sample name | Source | Sample id (GCl)/case id (Asterand) Lot no. | Tissue id (GCl)/Specimen id (Asternd) | Sample id (Asterand)/RNA id (GCl) |
|---|---|---|---|---|---|
| 7-B-Rectum | 1-(7)-Bc-Rectum | Biochain | A610297 | | |
| 8-B-Rectum | 2-(8)-Bc-Rectum | Biochain | A610298 | | |
| new colon | 3-GC-Colon | GCl | CDSUV | CDSUVNR3 | |
| new colon | 4-As-Colon | Asterand | 16364 | 31802 | 31802B1 |
| new colon | 5-As-Colon | Asterand | 22900 | 74446 | 74446B1 |
| new small bowl | 6-GC-Small bowl | GCl | V9L7D | V9L7DN6Z | |
| new small bowl | 7-GC-Small bowl | GCl | M3GVT | M3GVTN5R | |
| new small bowl | 8-GC-Small bowl | GCl | 196S2 | 196S2AJN | |
| 9-Am-Stomach | 9-(9)-Am-Stomach | Ambion | 110P04A | | |
| 10-B-Stomach | 10-(10)-Bc-Stomach | Biochain | A501159 | | |
| 11-B-Esophagus | 11-(11)-Bc-Esoph | Biochain | A603814 | | |
| 12-B-Esophagus | 12-(12)-Bc-Esoph | Biochain | A603813 | | |
| new pancreas | 13-As-Panc | Asterand | 8918 | 9442 | 9442C1 |
| new pancreas | 14-As-Panc | Asterand | 10082 | 11134 | 11134B1 |
| 48-CG-Liver | 15-(48)-Ic-Liver | Ichilov | CG-93-3 | | |
| new liver | 16-As-Liver | Asterand | 7916 | 7203 | 7203B1 |
| 28-Am-Bladder | 17-(28)-Am-Bladder | Ambion | 071P02C | | |
| 29-B-Bladder | 18-(29)-Bc-Bladder | Biochain | A504088 | | |
| 64-Am-Kidney | 19-(64)-Am-Kidney | Ambion | 111P0101B | | |
| 65-Cl-Kidney | 20-(65)-Cl-Kidney | Clontech | 1110970 | | |
| 66-B-Kidney | 21-(66)-Bc-Kidney | Biochain | A411080 | | |
| new kidney | 22-GC-Kidney | GCl | N1EVZ | N1EVZN91 | |
| new kidney | 23-GC-Kidney | GCl | BMl6W | BMl6WN9F | |
| 42-CG-Adrenal | 24-(42)-lc-Adrenal | Ichilov | CG-184-10 | | |
| 43-B-Adrenal | 25-(43)-Bc-Adrenal | Biochain | A610374 | | |
| 16-Am-Lung (L93) | 26-(16)-Am-Lung | Ambion | 111P0103A | | |
| 17-B-Lung (L92) | 27-(17)-Bc-Lung | Biochain | A503204 | | |
| new lung | 28-As-Lung | Asterand | 9078 | 9275 | 9275B1 |
| new lung | 29-As-Lung | Asterand | 6692 | 6161 | 6161A1 |
| new lung | 30-As-Lung | Asterand | 7900 | 7180 | 7180F1 |
| 75-G-Ovary | 31-(75)-GC-Ovary | GCl | L629FRV1 | | |
| 76-G-Ovary | 32-(76)-GC-Ovary | GCl | DWHTZRQX | | |
| 77-G-Ovary | 33-(77)-GC-Ovary | GCl | FDPL9NJ6 | | |
| 78-6-Ovary | 34-(78)-GC-Ovary | GCl | GWXUZN5M | | |
| 21-Am-Cervix | 35-(21)-Am-Cerix | Ambion | 101P0101A | | |
| new cervix | 36-GC-cervix | GCl | E2P2N | E2P2NAP4 | |
| 24-B-Uterus | 37-(24)-Bc-Uterus | Biochain | A411074 | | |
| 26-B-Uterus | 38-(26)-Bc-Uterus | Biochain | A504090 | | |
| 30-Am-Placenta | 39-(30)-Am-Placen | Ambion | 021P33A | | |
| 32-B-Placenta | 40-(32)-Bc-Placen | Biochain | A411073 | | |

TABLE 3_1-continued

| old sample name | sample name | Source | Sample id (GCl)/case id (Asterand) Lot no. | Tissue id (GCl)/Specimen id (Asternd) | Sample id (Asterand)/RNA id (GCl) |
|---|---|---|---|---|---|
| new breast | 41-GC-Breast | GCl | DHLR1 | | |
| new breast | 42-GC-Breast | GCl | TG6J6 | | |
| new breast | 43-GC-Breast | GCl | E6UDD | E6UDDNCF | |
| 38-Am-Prostate (P59) | 44-(38)-Am-Prostate | Ambion | 25955 | | |
| add prostate from prostate panel | 45-Bc-Prostate | Biochain | A609258 | | |
| new testis | 46-As-Testis | Asterand | 13071 | 19567 | 19567B1 |
| new testis | 47-As-Testis | Asterand | 19671 | 42120 | 42120A1 |
| ARTERY | 48-GC-Artery | GCl | 7FUUP | 7FUUPAMP | |
| ARTERY | 49-GC-Artery | GCl | YGTVY | YGTVYAIN | |
| blood cells | 50-Th-Blood-PBMC | Tel-Hashomer | 52497 | | |
| blood cells | 51-Th-Blood-PBMC | Tel-Hashomer | 31055 | | |
| blood cells | 52-Th-Blood-PBMC | Tel-Hashomer | 31058 | | |
| 54-CG-Spleen | 53-(54)-Ic-Spleen | Ichilov | CG-267 | | |
| 55-Am-Spleen | 54-(55)-Am-Spleen | Ambion | 111P0106B | | |
| 57-OG-Thymus | 55-(57)-Ic-Thymus | Ichilov | CG-98-7 | | |
| 58-Am-Thymus | 56-(58)-Am-Thymus | Ambion | 101P0101A | | |
| 60-B-Thyroid | 57-(60)-Bc-Thyroid | Biochain | A610287 | | |
| 62-CG-Thyroid | 58-(62)-lc-Thyroid | Ichilov | CG-119-2 | | |
| new salivary gland | 59-Gc-Sali gland | GCl | NNSMV | NNSMVNJC | |
| 67-CG-Cerebellum | 60-(67)-Ic-Cerebellum | Ichilov | CG-183-5 | | |
| 68-CG-Cerebellum | 61-(68)-Ic-Cerebellum | Ichilov | CG-212-5 | | |
| 69-B-Brain | 62-(69)-Bc-Brain | Biochain | A411322 | | |
| 71-B-Brain | 63-(71)-Bc-Brain | Biochain | A411079 | | |
| 72-CG-Brain | 64-(72)-Ic-Brain | Ichilov | CG-151-1 | | |
| 44-B-Heart | 65-(44)-Bc-Heart | Biochain | A411077 | | |
| 46-CG-Head | 66-(46)-Ic-Heart | Ichilov | CG-227-1 | | |
| 45-CG-Heart (Fibrotic) | 67-(45)-Ic-Heart (Fibrotic) | Ichilov | CG-255-9 | | |
| new skeletal muscle | 68-GC-Skel Mus | GCl | T8YZS | T8YZSN7O | |
| new skeletal muscle | 69-GC-Skel Mus | GCl | Q3WKA | Q3WKANCJ | |
| new skeletal muscle | 70-As-Skel Mus | Asterand | 8774 | 8235 | 823561 |
| new skeletal muscle | 71-As-Skel Mus | Asterand | 8775 | 8244 | 8244A1 |
| new skeletal muscle | 72-As-Skel Mus | Asterand | 10937 | 12648 | 12648C1 |
| new skeletal muscle | 73-As-Skel Mus | Asterand | 6692 | 6166 | 6166A1 |

Materials and Experimental Procedures

RNA preparation—RNA was obtained from Clontech (Franklin Lakes, N.J. USA 07417, dot clontech dot corn), BioChain Inst. Inc. (Hayward, Calif. 94545 USA dot biochain dot corn), ABS (Wilmington, Del. 19801, USA, dot absbioreagents dot corn) or Ambion (Austin, Tex. 78744 USA, dot ambion dot corn). Alternatively, RNA was generated from tissue samples using TRI-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 µg) was mixed with 150 ng Random Hexamer primers (Invitrogen) and 500 µM dNTP in a total volume of 15.6 µl. The mixture was incubated for 5 min at 65° C. and then quickly chilled on ice. Thereafter, 5 µl of 5× SuperscriptII first strand buffer (Invitrogen), 2.4 µl 0.1M DTT and 40 units RNasin (Promega) were added, and the mixture was incubated for 10 min at 25° C., followed by further incubation at 42° C. for 2 min. Then, 1 µl (200 units) of SuperscriptII (Invitrogen) was added and the reaction (final volume of 25 µl) was incubated for 50 min at 42° C. and then inactivated at 70° C. for 15 min. The resulting cDNA was diluted 1:20 in TE buffer (10 mM Tris pH=8, 1 mM EDTA pH=8).

Real-Time RT-PCR analysis—cDNA (511), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q=efficiency^{-Ct}$. The efficiency of the PCR reaction was calculated from a standard curve, created by using serial dilutions of several reverse transcription (RT) reactions. To minimize inherent differences in the RT reaction, the resulting relative quantities were normalized to normalization factor calculated in one of the following methods as indicated in the text:

Method 1—the geometric mean of the relative quantities of the selected housekeeping (HSKP) genes was used as normalization factor.

Method 2—The expression of several housekeeping (HSKP) genes was checked on every panel. The relative quantity (Q) of each housekeeping gene in each sample, calculted as described above, was diveded by the median quantity of this gene in all panel samples to obtain the "relative Q rel to MED". Then, for each sample the median of the "relative Q rel to MED" of the selected housekeeping genes was calculated and served as normalization factor of this sample for further calculations. Unless defined otherwise, the normalization of the Real-Time RT-PCR analysis results described herein was carried out according to method 1 above.

Schematic summary of quantitative real-time PCR analysis is presented in FIG. 3. As shown, the x-axis shows the cycle number. The $C_T$=Threshold Cycle point, which is the cycle that the amplification curve crosses the fluorescence threshold that was set in the experiment. This point is a calculated cycle number in which PCR product signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples in testing panel were as follows:

Ubiquitin (GenBank Accession No. BC000449 (SEQ ID NO:1711))

Ubiquitin Forward primer (SEQ ID NO: 326): ATTTGGGTCGCGGTTCTTG

Ubiquitin Reverse primer (SEQ ID NO: 327): TGCCTTGACATTCTCGATGGT

Ubiquitin-amplicon (SEQ ID NO: 328) ATTTGGGTCGCGGTTCTTGTTTGTGGATCGCTGTGATCGTCACTTGACAATGCAGATCTTCGTGAAGACTCTGACTGGTAAGACCATCACCCTCGAGG TTGAGCCCAGTGACACCATCGAGAATGTCAAGGCA SDHA (GenBank Accession No. NM_004168 (SEQ ID NO:1712))

SDHA Forward primer (SEQ ID NO: 329): TGGGAACAAGAGGGCATCTG

SDHA Reverse primer (SEQ ID NO: 330): CCACCACTGCATCAAATTCATG

SDHA-amplicon (SEQ ID NO: 331): TGGGAACAAGAGGGCATCTGCTAAAGTTTCAGATTCCATTTCTGCTCAGTATCCAGTAGTGGATCATGAATTTGATGCAGTGGTGG PBGD (GenBank Accession No. BC019323 (SEQ ID NO:1713)), PBGD Forward primer (SEQ ID NO: 332): TGAGAGTGATTCGCGTGGG PBGD Reverse primer (SEQ ID NO: 333): CCAGGGTACGAGGCTTTCAAT PBGD-amplicon (SEQ ID NO: 334): TGAGAGTGATTCGCGTGGGTACCCGCAAGAGCCAGCTTGCTCGCATACAGACGGACAGTGTGGTGGCAACATTGAAAGCCTCGTACCCTGG HPRT1 (GenBank Accession No. NM_000194 (SEQ ID NO:1714)), HPRT1 Forward primer (SEQ ID NO: 1295): TGACACTGGCAAAACAATGCA HPRT1 Reverse primer (SEQ ID NO: 1296): GGTCCTTTTCACCAGCAAGCT HPRT1-amplicon (SEQ ID NO: 1297): TGACACTGGCAAAACAATGCAGACTTTGCTTTCCTTGGTCAGGCAGTATAATCCAAAGATGGTCAAGGTCGCA AGCTTGCTGGTGAAAAGGACC The sequences of the housekeeping genes measured in all the examples on normal tissue samples panel were as follows:

RPL19 (GenBank Accession No. NM_000981 (SEQ ID NO:1715)),

RPL19 Forward primer (SEQ ID NO: 1298): TGGCAAGAAGAAGGTCTGGTTAG

RPL19 Reverse primer (SEQ ID NO: 1420): TGATCAGCCCATCTTTGATGAG

RPL19—amplicon (SEQ ID NO: 1630): TGGCAAGAAGAAGGTCTGGTTAGACCCCAATGAGACCAATGAAATCGCCAATGCCAACTCCCGTCAGCAGATCCGGAAGCTCATCAAAGATGGGCTGATCA TATA box (GenBank Accession No. NM_003194 (SEQ ID NO:1716)), TATA box Forward primer (SEQ ID NO: 1631): CGGTTTGCTGCGGTAATCAT TATA box Reverse primer (SEQ ID NO: 1632): TTTCTTGCTGCCAGTCTGGAC TATA box—amplicon (SEQ ID NO: 1633): CGGTTTGCTGCGGTAATCATGAGGATAAGAGAGCCACGAACCACGGCACTGATTTTCAGTTCTGGGAAAATGGTGTGCACAGGAGCCAAGAGTGAAGAACAGTCCAGACTGGCAGCAAGAAA Ubiquitin (GenBank Accession No. BC000449 (SEQ ID NO:1711))

Ubiquitin Forward primer (SEQ ID NO: 326): ATTTGGGTCGCGGTTCTTG

Ubiquitin Reverse primer (SEQ ID NO: 327): TGCCTTGACATTCTCGATGGT

Ubiquitin-amplicon (SEQ ID NO: 328) ATTTGGGTCGCGGTTCTTGTTTGTGGATCGCTGTGATCGTCACTTGACAATGCAGATCTTCGTGAAGACTCTGACTGGTAAGACCATCACCCTCGAGG TTGAGCCCAGTGACACCATCGAGAATGTCAAGGCA SDHA (GenBank Accession No. NM_004168 (SEQ ID NO:1712))

SDHA Forward primer (SEQ ID NO: 329): TGGGAACAAGAGGGCATCTG

SDHA Reverse primer (SEQ ID NO: 330): CCACCACTGCATCAAATTCATG

SDHA—amplicon (SEQ ID NO: 331): TGGGAACAAGAGGGCATCTGCTAAAGTTTCAGATTCCATTTCTGCTCAGTATCCAGTAGTGGATCATGAATTTGATGCAGTGGTGG Oligonucleotide-Based Micro-Array Experiment Protocol-Microarray Fabrication Microarrays (chips) were printed by pin deposition using the MicroGrid II MGII 600 robot from BioRobotics Limited (Cambridge, UK). 50-mer oligonucleotides target sequences were designed by Compugen Ltd (Tel-Aviv, Ill.) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., U.S.) and all of the oligonucleotides were joined to a C6 amino-modified linker at the 5' end, or being attached directly to CodeLink slides (Cat #25-6700-01. Amersham Bioscience, Piscataway, N.J., U.S.). The 50-mer oligonucleotides, forming the target sequences, were first suspended in Ultra-pure DDW (Cat # 01-866-1A Kibbutz Beit-Haemek, Israel) to a concentration of 50 µM. Before printing the slides, the oligonucleotides were resuspended in 300 mM sodium phosphate (pH 8.5) to final concentration of 150 mM and printed at 35-40% relative humidity at 21° C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are *E. coli* spikes 1-6, which are oligos to *E-Coli* genes which are commercially available in the Array Control product (Array control—sense oligo spots, Ambion Inc. Austin, Tex. Cat #1781, Lot #112K06).

Post-Coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50° C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (100 ml/slide. 4×SSC, 0.1% SDS)) at 50° C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation™, to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit.

Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Figure 4:
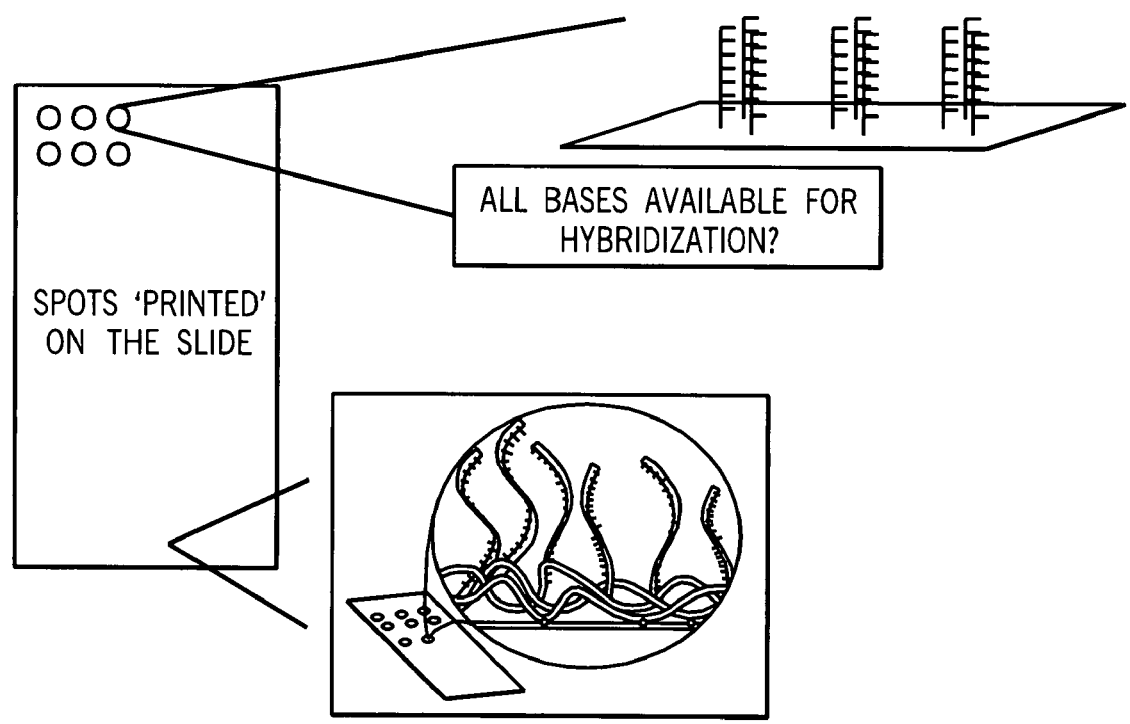
FIG. 4 is schematic presentation of the oligonucleotide based microarray fabrication.
Figure 5:
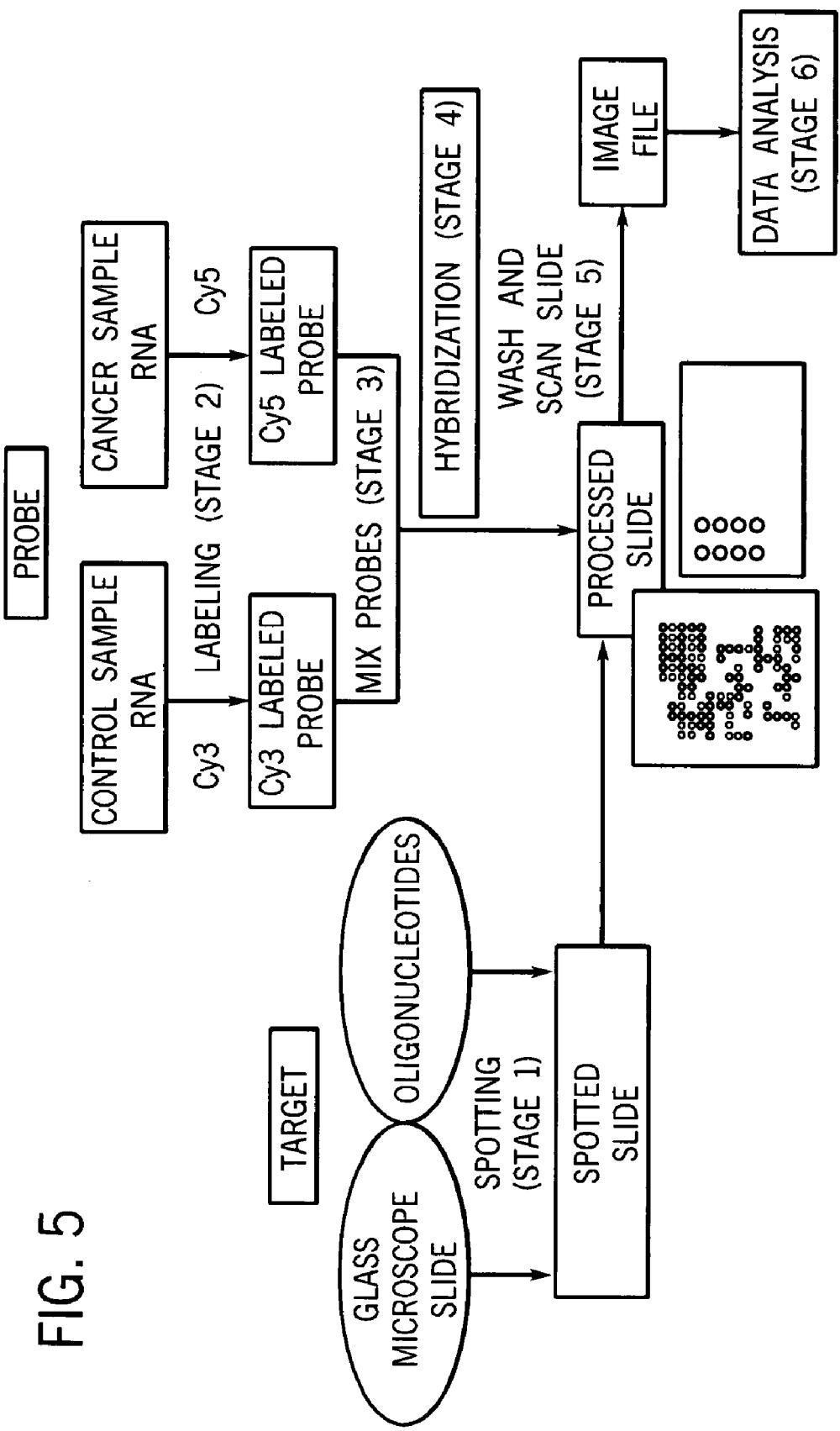
FIG. 5 is schematic summary of the oligonucleotide based microarray experimental flow.

Schematic summary of the oligonucleotide based microarray fabrication and the experimental flow is presented in FIGS. 4 and 5.

Briefly, as shown in FIG. 4, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification. This binding ensures that the full length of the DNA oligonucleotides is available for hybridization to the cDNA and also allows lower background, high sensitivity and reproducibility.

FIG. 5 shows a schematic method for performing the microarray experiments. It should be noted that stages on the left-hand or right-hand side may optionally be performed in any order, including in parallel, until stage 4 (hybridization). Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

The following clusters were found to be overexpressed in lung cancer:

W60282_PEA_1

F05068_PEA_1

H38804_PEA_1

HSENA78

T39971

(R00299)

H14624

Z41644_PEA_1

Z25299_PEA_2

HSSTROL3

HUMTREFAC_PEA_2

HSS100PCB

HSU33147_PEA_1

HUMCA1XIA

H61775

HUMGRP5E

HUMODCA

AA161187

R66178

D56406_PEA_1

M85491_PEA_1

Z21368_PEA_1

HUMCA1XIA

R20779

R38144_PEA_2

Z44808_PEA_1

HUMOSTRO_PEA_1_PEA_1

R11723_PEA_1

AI076020

T23580
M79217_PEA_1
M62096_PEA_1
M78076_PEA_1
T99080_PEA_4
T08446_PEA_1
R16276_PEA_1

The following clusters were found to be overexpressed in lung small cell cancer:
    H61775
    HUMGRP5E
    M85491_PEA_1
    Z44808_PEA_1
    AA161187
    R66178
    HUMPHOSLIP_PEA_2
    AI076020
    T23580
    M79217_PEA_1
    M62096_PEA_1
    M78076_PEA_1
    T99080_PEA_4
    T08446_PEA_1

The following clusters were found to be overexpressed in lung adenocarcinoma:
    R00299
    M85491_PEA_1
    Z21368_PEA_1
    HUMCA1XIA
    AA161187
    R66178
    T11628_PEA_1

The following clusters were found to be overexpressed in lung squamous cell:
    HUMODCA
    R00299
    D56406_PEA_1
    Z44808_PEA_1
    Z21368_PEA_1
    HUMCA1XIA
    AA161187
    R66178
    HUMCEA_PEA_1
    R35137_PEA_1_PEA_1_PEA_1

Description for Cluster H61775

Cluster H61775 features 2 transcript(s) and 6 segment(s) of interest, the names for which are given in Tables 4 and 5, respectively, the sequences themselves are given at the end of the application. The selected protein variants are given in table 6.

TABLE 4

Transcripts of interest

| Transcript Name | Sequence ID No. |
| --- | --- |
| H61775_T21 | 1 |
| H61775_T22 | 2 |

TABLE 5

Segments of interest

| Segment Name | Sequence ID No. |
| --- | --- |
| H61775_node_2 | 151 |
| H61775_node_4 | 152 |
| H61775_node_6 | 153 |
| H61775_node_8 | 154 |
| H61775_node_0 | 155 |
| H61775_node_5 | 156 |

TABLE 6

Proteins of interest

| Protein Name | Sequence ID No. |
| --- | --- |
| H61775_P16 | 1281 |
| H61775_P17 | 1282 |

Cluster H61775 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 6 refer to weighted expression of ESTs in each category, as "parts per million" (ratio of the expression of ESTs for a particular cluster to the expression of all ESTs in that category, according to parts per million).

Figure 6:
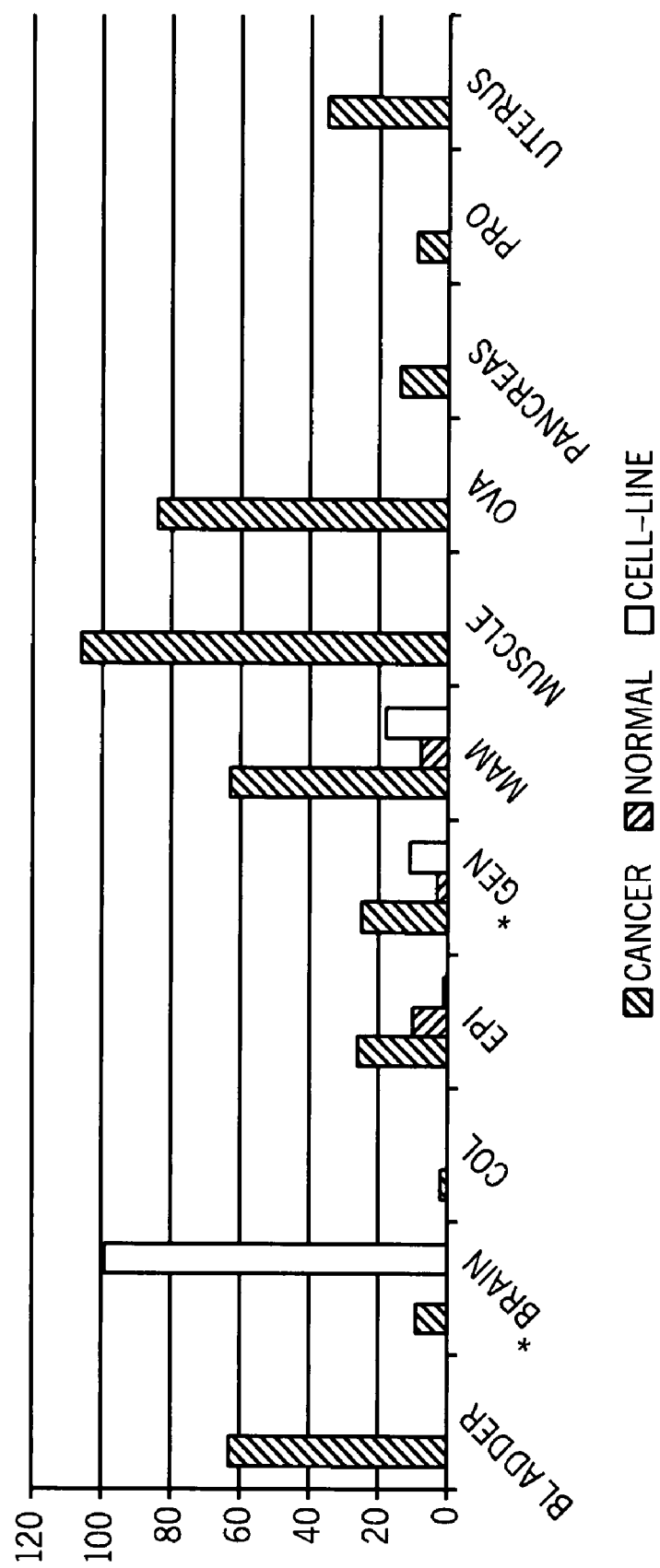
FIG. 6 is a histogram showing Cancer and cell-line vs. normal tissue expression for Cluster H61775, demonstrating overexpression in brain malignant tumors and a mixture of malignant tumors from different tissues.

Overall, the following results were obtained as shown with regard to the histograms in FIG. 6 and Table 7. This cluster is overexpressed (at least at a minimum level) in the following pathological conditions: brain malignant tumors and a mixture of malignant tumors from different tissues.

TABLE 7

Normal tissue distribution

| Name of Tissue | Number |
| --- | --- |
| bladder | 0 |
| brain | 0 |
| colon | 0 |
| epithehal | 10 |
| general | 3 |
| breast | 8 |
| muscle | 0 |
| ovary | 0 |
| pancreas | 0 |
| prostate | 0 |
| uterus | 0 |

TABLE 8

P values and ratios for expression in cancerous tissue

| Name of Tissue | P1 | P2 | SP1 | R3 | SP2 | R4 |
| --- | --- | --- | --- | --- | --- | --- |
| bladder | 3.1e−01 | 3.8e−01 | 3.2e−01 | 2.5 | 4.6e−01 | 1.9 |
| brain | 8.8e−02 | 6.5e−02 | 1 | 3.5 | 4.1e−04 | 5.8 |
| colon | 5.6e−01 | 6.4e−01 | 1 | 1.1 | 1 | 1.1 |
| epithelial | 3.0e−02 | 1.3e−01 | 2.3e−02 | 2.1 | 3.2e−01 | 1.2 |
| general | 1.3e−06 | 4.9e−05 | 1.0e−07 | 6.3 | 1.5e−06 | 4.3 |
| breast | 4.7e−01 | 3.7e−01 | 3.3e−01 | 2.0 | 4.6e−01 | 1.6 |
| muscle | 2.3e−01 | 2.9e−01 | 1.5e−01 | 6.8 | 3.9e−01 | 2.6 |
| ovary | 3.8e−01 | 4.2e−01 | 1.5e−01 | 2.4 | 2.6e−01 | 1.9 |
| pancreas | 3.3e−01 | 4.4e−01 | 4.2e−01 | 2.4 | 5.3e−01 | 1.9 |
| prostate | 7.3e−01 | 7.8e−01 | 6.7e−01 | 1.5 | 7.5e−01 | 1.3 |
| uterus | 1.0e−01 | 2.6e−01 | 2.9e−01 | 2.6 | 5.1e−01 | 1.8 |

As noted above, contig H61775 features 2 transcript(s), which were listed in Table 4 above. A description of each variant protein according to the present invention is now provided.

Variant protein H61775_P16 (SEQ ID NO:1281) according to the present invention has an amino acid sequence as given at the end of the application; it is encoded by transcript(s) H61775 T21 (SEQ ID NO:1). One or more alignments to one or more previously published protein sequences are given at the end of the application. A brief description of the relationship of the variant protein according to the present invention to each such aligned protein is as follows:

Comparison report between H61775_P16 (SEQ ID NO:1281) and Q9P2J2 (SEQ ID NO:1694):

1. An isolated chimeric polypeptide encoding for H61775_P16 (SEQ ID NO:1281), comprising a first amino acid sequence being at least 90% homologous to MVWCLGLAVLSLVISQGADGRGKPEVVSVVGRAGESVVLGCDLLPPAGRPPLHVIEWLRFGFLLPIFIQFGLYSPR1DPDYVG corresponding to amino acids 11-93 of Q9P2J2 (SEQ ID NO:1694), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGFPAFRELKRAETVSPVFFTRRCIWEDLKSTGFSPAGGGRPPGGGPRTQEDSGLPCWRSSCSVTLQV (SEQ ID NO:1754) corresponding to amino acids 84-152 of H61775_P16 (SEQ ID NO:1281), wherein said first and second amino acid sequences are contiguous and in a sequential order.

2. An isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIWEDLKSTGFSPAGGGRPPGGGPRTQEDSGLPCWRSSCSVTLQV (SEQ ID NO:1754) in H61775_P16 (SEQ ID NO:1281).

Comparison report between H61775_P16 (SEQ ID NO:1281) and AAQ88495 (SEQ ID NO:1695):

1. An isolated chimeric polypeptide encoding for H61775_P16 (SEQ ID NO:1281), comprising a first amino acid sequence being at least 90% homologous to MVWCLGLAVLSLVISQGADGRGKPEVVSVVGRAGESVVLGCDLLPPAGRPPLHVIEWLRFGFLLPIFIQFGLYSPR1DPDYVG corresponding to amino acids 1-83 of AAQ88495 (SEQ ID NO:1695), which also corresponds to amino acids 1-83 of H61775_P16 (SEQ ID NO:1281), and a second amino acid sequence being at least 70%, optionally at least 80%, preferably at least 85%, more preferably at least 90% and most preferably at least 95% homologous to a polypeptide having the sequence DCGFPAFRELKRAETVSPVFFTRRCIWEDLKSTGFSPAGGGRPPGGGPRTQEDSGLPCWRSSCSVTLQV (SEQ ID NO:1754) corresponding to amino acids 84-152 of H61775_P16 (SEQ ID NO:1281), wherein said first and second amino acid sequences are contiguous and in a sequential order.

2. An isolated polypeptide encoding for a tail of H61775_P16 (SEQ ID NO:1281), comprising a polypeptide being at least 70%, optionally at least about 80%, preferably at least about 85%, more preferably at least about 90% and most preferably at least about 95% homologous to the sequence DCGFPAFRELKRAETVSPVFFTRRCIWEDLKSTGFSPAGGGRPPGGGPRTQEDSGLPCWRSSCSVTLQV (SEQ ID NO:1754) in H61775_P16 (SEQ ID NO:1281).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P16 (SEQ ID NO:1281) also has the following non-silent SNPs (Single Nucleotide Polymorphisms) as listed in Table 9, (given according to their position(s) on the amino acid sequence, with the alternative amino acid(s) listed; the last column indicates whether the SNP is known or not; the presence of known SNPs in variant protein H61775_P16 (SEQ ID NO:1281) sequence provides support for the deduced sequence of this variant protein according to the present invention).

TABLE 9

Amino acid mutations

| SNP position(s) on amino acid sequence | Alternative amino acid(s) | Previously known SNP? |
|---|---|---|
| 14 | I -> T | No |
| 138 | G -> R | No |
| 34 | G -> E | Yes |
| 48 | G -> R | No |
| 91 | R -> * | Yes |

Variant protein H61775_P16 (SEQ ID NO:1281) is encoded by the following transcript(s): H61775_T21 (SEQ ID NO:1), for which the sequence(s) is/are given at the end of the application. The coding portion of transcript H61775_T21 (SEQ ID NO:1) is shown in bold; this coding portion starts at position 261 and ends at position 716. The transcript also has the following SNPs as listed in Table 10 (given according to their position on the nucleotide sequence, with the alternative nucleic acid listed; the last column indicates whether the SNP is known or not; the presence of known SNPs in variant protein H61775_P16 (SEQ ID NO:1281) sequence provides support for the deduced sequence of this variant protein according to the present invention).

TABLE 10

Nucleic acid SNPs

| SNP position on nucleotide sequence | Alternative nucleic acid | Previously known SNP? |
|---|---|---|
| 117 | T -> C | Yes |
| 200 | T -> C | No |
| 672 | G -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 531 | C -> T | Yes |
| 566 | T -> C | No |

Variant protein H61775_P17 (SEQ ID NO:1282) according to the present invention has an amino acid sequence as given at the end of the application; it is encoded by transcript(s) H61775_T22 (SEQ ID NO:2). One or more alignments to one or more previously published protein sequences are given at the end of the application. A brief description of the relationship of the variant protein according to the present invention to each such aligned protein is as follows:

Comparison report between H61775_P17 (SEQ ID NO:1282) and Q9P2J2 (SEQ ID NO:1694):

1. An isolated chimeric polypeptide encoding for H61775_P17 (SEQ ID NO:1282), comprising a first amino acid sequence being at least 90% homologous to MVW-CLGLAVLSLVISQGADGRGKPEVVSV-VGRAGESVVLGCDLLPPAGRPPLH-VIEWLRFGFLLPIFIQFGLYSPR1 DPDYVG corresponding to amino acids 11-93 of Q9P2J2 (SEQ ID NO:1694), which also corresponds to amino acids 1-83 of H61775 P17 (SEQ ID NO:1282).

Comparison report between H61775_P17 (SEQ ID NO:1282) and AAQ88495 (SEQ ID NO:1695):

1. An isolated chimeric polypeptide encoding for H61775_P17 (SEQ ID NO:1282), comprising a first amino acid sequence being at least 90% homologous to MVW-CLGLAVLSLVISQGADGRGKPEVVSV-VGRAGESVVLGCDLLPPAGRPPLH-VIEWLRFGFLLPIFIQFGLYSPR1 DPDYVG corresponding to amino acids 1-83 of AAQ88495 (SEQ ID NO:1695), which also corresponds to amino acids 1-83 of H61775_P17 (SEQ ID NO:1282).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H61775_P17 (SEQ ID NO:1282) also has the following non-silent SNPs (Single Nucleotide Polymorphisms) as listed in Table 11, (given according to their position(s) on the amino acid sequence, with the alternative amino acid(s) listed; the last column indicates whether the SNP is known or not; the presence of known SNPs in variant protein H61775_P17 (SEQ ID NO:1282) sequence provides support for the deduced sequence of this variant protein according to the present invention).

TABLE 11

Amino acid mutations

| SNP position(s) on amino acid sequence | Alternative amino acid(s) | Previously known SNP? |
|---|---|---|
| 14 | I -> T | No |
| 34 | G -> E | Yes |
| 48 | G -> R | No |

Variant protein H61775_P17 (SEQ ID NO:1282) is encoded by the following transcript(s): H61775 T22 (SEQ ID NO:2), for which the sequence(s) is/are given at the end of the application. The coding portion of transcript H61775_T22 (SEQ ID NO:2) is shown in bold; this coding portion starts at position 261 and ends at position 509. The transcript also has the following SNPs as listed in Table 12 (given according to their position on the nucleotide sequence, with the alternative nucleic acid listed; the last column indicates whether the SNP is known or not; the presence of known SNPs in variant protein H61775_P17 (SEQ ID NO:1282) sequence provides support for the deduced sequence of this variant protein according to the present invention).

TABLE 12

Nucleic acid SNPs

| SNP position on nucleotide sequence | Alternative nucleic acid | Previously known SNP? |
|---|---|---|
| 117 | T -> C | Yes |
| 200 | T -> C | No |
| 222 | T -> C | Yes |
| 301 | T -> C | No |
| 361 | G -> A | Yes |
| 377 | G -> A | No |
| 400 | -> C | No |
| 402 | G -> C | No |
| 596 | T -> A | Yes |

As noted above, cluster H61775 features 6 segment(s), which were listed in Table 5 above and for which the sequence(s) are given at the end of the application. These segment(s) are portions of nucleic acid sequence(s) which are described herein separately because they are of particular interest. A description of each segment according to the present invention is now provided.

Segment cluster H61775_node_2 (SEQ ID NO:1022) according to the present invention is supported by 17 libraries. The number of libraries was determined as previously described. This segment can be found in the following transcript(s): H61775_T21 (SEQ ID NO:1) and H61775_T22 (SEQ ID NO:2). Table 13 below describes the starting and ending position of this segment on each transcript.

TABLE 13

Segment location on transcripts

| Transcript name | Segment starting position | Segment ending position |
|---|---|---|
| H61775_T21 (SEQ ID NO:1) | 87 | 318 |
| H61775_T22 (SEQ ID NO:2) | 87 | 318 |

Segment cluster H61775_node_4 (SEQ ID NO:1023) according to the present invention is supported by 20 libraries. The number of libraries was determined as previously described. This segment can be found in the following transcript(s): H61775_T21 (SEQ ID NO:1) and H61775_T22 (SEQ ID NO:2). Table 14 below describes the starting and ending position of this segment on each transcript.

TABLE 14

Segment location on transcripts

| Transcript name | Segment starting position | Segment ending position |
|---|---|---|
| H61775_T21 (SEQ ID NO:1) | 319 | 507 |
| H61775_T22 (SEQ ID NO:2) | 319 | 507 |

Segment cluster H61775_node_6 (SEQ ID NO:1024) according to the present invention is supported by 1 libraries. The number of libraries was determined as previously described. This segment can be found in the following transcript(s): H61775_T22 (SEQ ID NO:2). Table 15 below describes the starting and ending position of this segment on each transcript.

TABLE 15

Segment location on transcripts

| Transcript name | Segment starting position | Segment ending position |
|---|---|---|
| H61775_T22 (SEQ ID NO:2) | 515 | 715 |

Segment cluster H61775_node_8 (SEQ ID NO:1025) according to the present invention is supported by 5 libraries. The number of libraries was determined as previously described. This segment can be found in the following transcript(s): H61775_T21 (SEQ ID NO:1). Table 16 below describes the starting and ending position of this segment on each transcript.

TABLE 16

Segment location on transcripts

| Transcript name | Segment starting position | Segment ending position |
|---|---|---|
| H61775_T21 (SEQ ID NO:1) | 508 | 1205 |

According to an optional embodiment of the present invention, short segments related to the above cluster are also provided. These segments are up to about 120 bp in length, and so are included in a separate description.

Segment cluster H61775_node_0 (SEQ ID NO:1026) according to the present invention is supported by 4 libraries. The number of libraries was determined as previously described. This segment can be found in the following transcript(s):

H61775_T21 (SEQ ID NO:1) and H61775_T22 (SEQ ID NO:2). Table 17 below describes the starting and ending position of this segment on each transcript.

TABLE 17

Segment location on transcripts

| Transcript name | Segment starting position | Segment ending position |
|---|---|---|
| H61775_T21 (SEQ ID NO:1) | 1 | 86 |
| H61775_T22 (SEQ ID NO:2) | 1 | 86 |

Segment cluster H61775_node_5 (SEQ ID NO:1027) according to the present invention can be found in the following transcript(s): H61775_T22 (SEQ ID NO:2). Table 18 below describes the starting and ending position of this segment on each transcript.

TABLE 18

Segment location on transcripts

| Transcript name | Segment starting position | Segment ending position |
|---|---|---|
| H61775_T22 (SEQ ID NO:2) | 508 | 514 |

Microarray (chip) data is also available for this gene as follows. As described above with regard to the cluster itself, various oligonucleotides were tested for being differentially expressed in various disease conditions, particularly cancer. The following oligonucleotides were found to hit this segment (with regard to lung cancer), shown in Table 19.

TABLE 19

Oligonucleotides related to this gene

| Oligonucleotide name | Overexpressed in cancers | Chip reference |
|---|---|---|
| H61775_0_11_0 (SEQ ID NO:204) | Lung cancer | Lung |

Variant protein alignment to the previously known protein:

Sequence name: /tmp/Psw0RJLCti/aLAXQjXh07:Q9P2J2 (SEQ ID NO:1694)

Sequence documentation:

Alignment of: H61775_P16 (SEQ ID NO:1281) x Q9P2J2 (SEQ ID NO:1694) . . .

Alignment segment 1/1:

| | |
|---|---|
| Quality: 803.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
11 MVWCLGLAVLSLVISQGADGRGKPEVVSVVGRAGESVVLGCDLLPPAGRP 60

51 PLHVIEWLRFGFLLPIFIQFGLYSPRIDPDYVG                  83
   ||||||||||||||||||||||||||||||||
61 PLHVIEWLRFGFLLPIFIQFGLYSPRIDPDYVG                  93
```

Sequence name: /tmp/Psw0RJLCti/aLAXQjXh07:
AAQ88495 (SEQ ID NO:1695)

Sequence documentation:

Alignment of: H61775_P16 (SEQ ID NO:1281) x AAQ88495 (SEQ ID NO:1695) . . .

Alignment segment 1/1:

| | |
|---|---|
| Quality: 803.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
 1 MVWCLGLAVLSLVISQGADGRGKPEVVSVVGRAGESVVLGCDLLPPAGRP 50

51 PLHVIEWLRFGFLLPIFIQFGLYSPRIDPDYVG               83
   ||||||||||||||||||||||||||||||||
51 PLHVIEWLRFGFLLPIFIQFGLYSPRIDPDYVG               83
```

Sequence name: /tmp/naab8yR3GC/pSM4l2IL5o:Q9P2J2 (SEQ ID NO:1694)

Sequence documentation:

Alignment of: H61775_P17 (SEQ ID NO:1282) x Q9P2J2 (SEQ ID NO:1694) . . .

Alignment segment 1/1:

| | |
|---|---|
| Quality: 803.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1 MVWCLGLAVLSLVISQGADGRGKPEVVSVVGRAGESVVLGCDLLPPAGRP 50
   |||||||||||||||||||||||||||||||||||||||||||||||||
11 MVWCLGLAVLSLVISQGADGRGKPEVVSVVGRAGESVVLGCDLLPPAGRP 60

51 PLHVIEWLRFGFLLPIFIQFGLYSPRIDPDYVG               83
   ||||||||||||||||||||||||||||||||
61 PLHVIEWLRFGFLLPIFIQFGLYSPRIDPDYVG               93
```

Sequence name: /tmp/naab8yR3GC/pSM4l2IL5o: AAQ88495 (SEQ ID NO:1695)

Sequence documentation:

Alignment of: H61775_P17 (SEQ ID NO:1282) x AAQ88495 (SEQ ID NO:1695) . . .

Alignment segment 1/1:

| | |
|---|---|
| Quality: 803.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MVWCLGLAVLSLVISQGADGRGKPEVVSVVGRAGESVVLGCDLLPPAGRP 50
    ||||||||||||||||||||||||||||||||||||||||||||||||||
  1 MVWCLGLAVLSLVISQGADGRGKPEVVSVVGRAGESVVLGCDLLPPAGRP 50

51 PLHVIEWLRFGFLLPIFIQFGLYSPRIDPDYVG                  83
    ||||||||||||||||||||||||||||||||
 51 PLHVIEWLRFGFLLPIFIQFGLYSPRIDPDYVG                  83
```

Expression of Immunoglobulin Superfamily, Member 9, H61775 Transcripts which are Detectable by Amplicon as Depicted in Sequence Name H61775Seg8 (SEQ ID NO:1636) in Normal and Cancerous Lung Tissues Expression of immunoglobulin superfamily, member 9 transcripts detectable by or according to seg8, H61775seg8 amplicon (SEQ ID NO:1636) and H61775seg8F2 (SEQ ID NO:1634) and H61775seg8R2 (SEQ ID NO:1635) primers was measured by real time PCR. In parallel the expression of four housekeeping genes—PBGD (GenBank Accession No. BC019323 (SEQ ID NO:1713); amplicon—PBGD-amplicon, SEQ ID NO:334, primers SEQ ID NOs 332 and 333), HPRT1 (GenBank Accession No. NM_000194 (SEQ ID NO:1714); amplicon—HPRT1-amplicon, SEQ ID NO:1297; primers SEQ ID NOs 1295 and 1296), Ubiquitin (GenBank Accession No. BC000449 (SEQ ID NO:1711); amplicon—Ubiquitin-amplicon, SEQ ID NO:328, primers SEQ ID NOs 326 and 327) and SDHA (GenBank Accession No. NM_004168 (SEQ ID NO:1712); amplicon—SDHA-amplicon, SEQ ID NO:331; primers SEQ ID NOs 329 and 330) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel"), to obtain a value of fold up-regulation for each sample relative to median of the normal PM samples.

Figure 7:
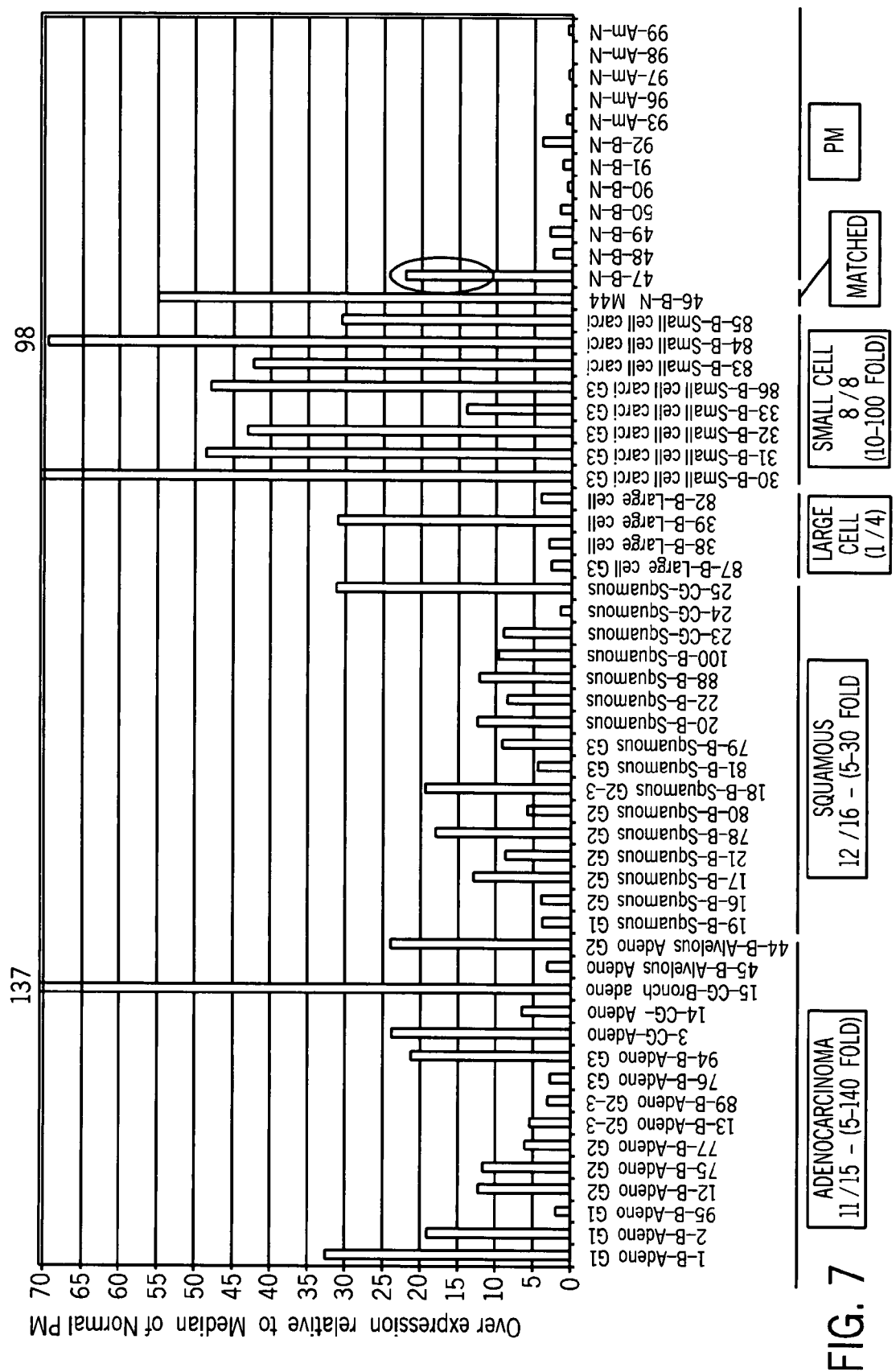
FIG. 7 is a histogram showing expression of transcripts of variants of the immunoglobulin superfamily, member 9, H61775 transcripts, which are detectable by amplicon as depicted in sequence name H61775seg8 (SEQ ID NO:1636), in normal and cancerous lung tissues.

FIG. 7 is a histogram showing over expression of the above-indicated immunoglobulin superfamily, member 9 transcripts in cancerous lung samples relative to the normal samples. The number and percentage of samples that exhibit at least 5 fold over-expression, out of the total number of samples tested, is indicated in the bottom.

As is evident from FIG. 7, the expression of immunoglobulin superfamily, member 9 transcripts detectable by the above amplicon(s) in cancer samples was significantly higher than in the non-cancerous samples (Sample Nos. 47-50, 90-93, 96-99, Table 2 "Tissue samples in testing panel"). Notably an over-expression of at least 5 fold was found in 11 out of 15 adenocarcinoma samples, 12 out of 16 squamous cell carcinoma samples, 1 out of 4 samples of large cell carcinoma samples and in 8 out of 8 small cell carcinoma samples.

Statistical analysis was applied to verify the significance of these results, as described below.

The P value for the difference in the expression levels of immunoglobulin superfamily, member 9 transcripts detectable by the above amplicon in lung cancer samples versus the normal tissue samples was determined by T test as 6.5E-02. In adenocarcinoma, the minimum values were 7.62E-03 in squamous cell adenocarcinoma cancer and 1.5E-03 in small cell carcinoma.

Threshold of 5 fold overexpression was found to differentiate between cancer and normal samples with P value of 9.62E-04 in adenocarcinoma, 5.9E-04 in squamous cell carcinoma, and a threshold of 10 fold overexpression was found to differentiate between small cell adenocarcinoma cancer and normal samples with P value of 7.14E-05 as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: H61775seg8F2 forward primer (SEQ ID NO: 1634); and H61775seg8R2 reverse primer (SEQ ID NO: 1635).

The present invention also preferably encompasses any amplicon obtained through the use of any suitable primer pair; for example, for the above experiment, the following amplicon was obtained as a non-limiting illustrative example only of a suitable amplicon: H61775seg8 (SEQ ID NO:1636).

H61775seg8F2 (SEQ ID NO:1634)

GAAGGCTCTTGTCACTTACTAGCCAT

H61775seg8R2 (SEQ ID NO:1635)

TGTCACCATATTTAATCCTCCCAA

H61775seg8 (SEQ ID NO:1636)

GAAGGCTCTTGTCACTTACTAGCCATGT-GATTTTGGAMGAAACTTAACATTAATTC-CTTCAGCTACAATGGA ATTCTTGGGAGGAT-TAAATATGGTGACA

Expression of Immunoglobulin Superfamily, Member 9, H61775 Transcripts which are Detectable by Amplicon as Depicted in Sequence Name H61775Seg8 (SEQ ID NO:1636) in Different Normal Tissues.

Expression of immunoglobulin superfamily, member 9 transcripts detectable by or according to H61775 seg8 amplicon (SEQ ID NO:1636) and H61775 seg8F2 (SEQ ID NO:1634) and H61775 seg8R2 (SEQ ID NO:1635) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 4, "Tissue sample in normal panel", above), to obtain a value of relative expression of each sample relative to median of the ovary samples.

H61775seg8F2 (SEQ ID NO:1634)

GAAGGCTCTTGTCACTTACTAGCCAT

H61775seg8R2 (SEQ ID NO:1635)

TGTCACCATATTTAATCCTCCCAA

H61775seg8 (SEQ ID NO:1636)

GMGGCTCTTGTCACTTACTAGCCATGT-
GATTTTGGAAAGAAACTTAACATTAAT-
TCCTTCAGCTACAATGGA ATTCTTGGGAGGAT-
TAAATATGGTGACA

Figure 8:
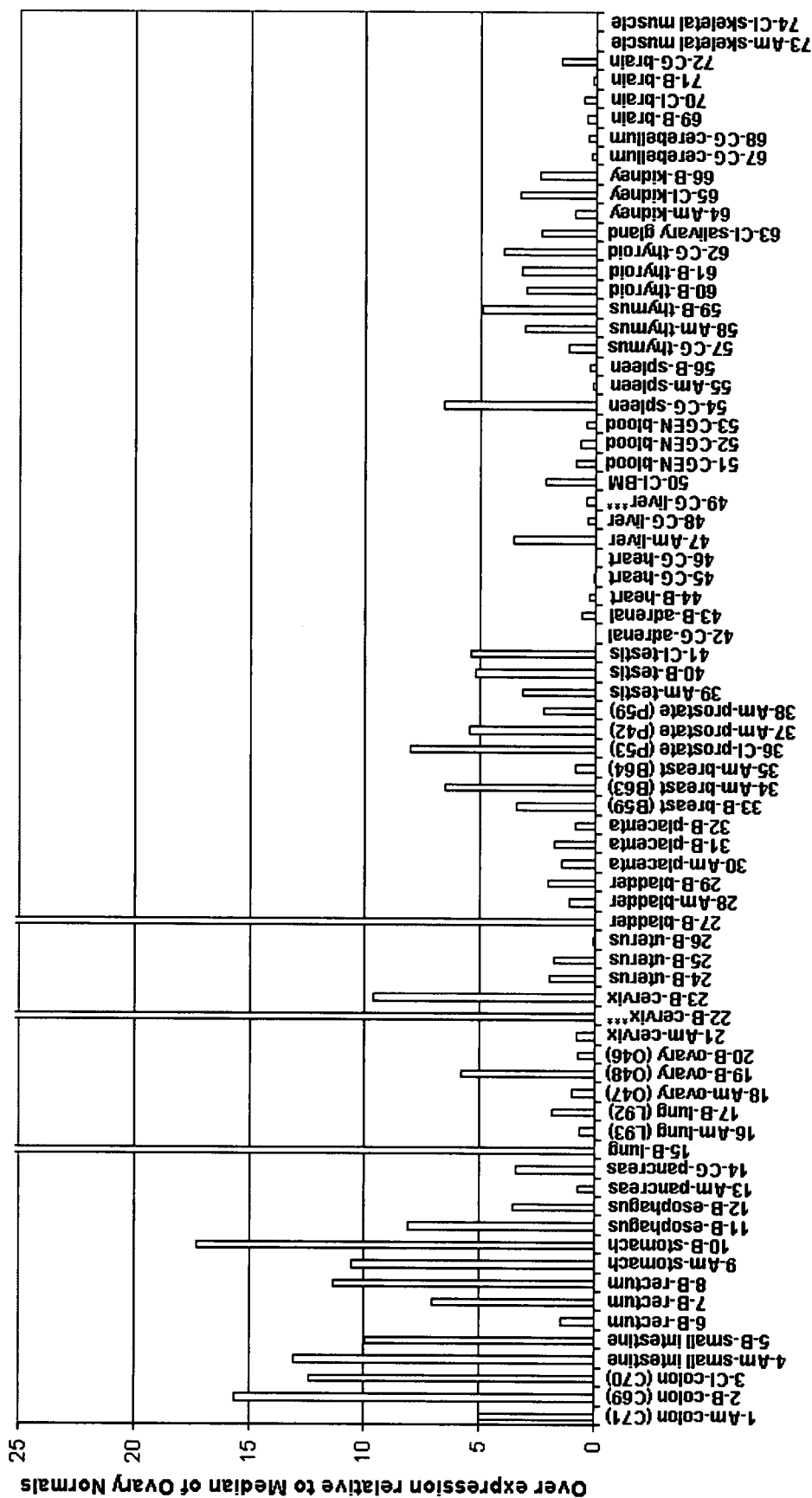
FIG. 8 is a histogram showing expression of immunoglobulin superfamily, member 9, H61775 transcripts, which are detectable by amplicon as depicted in sequence name H61775seg8 (SEQ ID NO: 1636), in different normal tissues.

The results are demonstrated in FIG. 8, showing expression of immunoglobulin superfamily, member 9, H61775 transcripts, which are detectable by amplicon as depicted in sequence name H61775seg8 (SEQ ID NO:1636), in different normal tissues.

Description for Cluster M85491

Cluster M85491 features 2 transcript(s) and 11 segment(s) of interest, the names for which are given in Tables 20 and 21, respectively, the sequences themselves are given at the end of the application. The selected protein variants are given in table 22.

TABLE 20

Transcripts of interest

| Transcript Name | Sequence ID No. |
|---|---|
| M85491_PEA_1_T16 | 3 |
| M85491_PEA_1_T20 | 4 |

TABLE 21

Segments of interest

| Segment Name | Sequence ID No. |
|---|---|
| M85491_PEA_1_node_0 | 157 |
| M85491_PEA_1_node_13 | 158 |
| M85491_PEA_1_node_21 | 159 |
| M85491_PEA_1_node_23 | 160 |
| M85491_PEA_1_node_24 | 161 |
| M85491_PEA_1_node_8 | 162 |
| M85491_PEA_1_node_9 | 163 |
| M85491_PEA_1_node_10 | 164 |
| M85491_PEA_1_node_18 | 165 |
| M85491_PEA_1_node_19 | 166 |
| M85491_PEA_1_node_6 | 167 |

TABLE 22

Proteins of interest

| Protein Name | Sequence ID No. |
|---|---|
| M85491_PEA_1_P13 | 1283 |
| M85491_PEA_1_P14 | 1284 |

These sequences are variants of the known protein Ephrin type-B receptor 2 [precursor] (SwissProt accession identifier EPB2_HUMAN; known also according to the synonyms EC 2.7.1.112; Tyrosine-protein kinase receptor EPH-3; DRT; Receptor protein-tyrosine kinase HEK5; ERK), SEQ ID NO:1417, referred to herein as the previously known protein.

Protein Ephrin type-B receptor 2 [precursor] (SEQ ID NO:1417) is known or believed to have the following function(s): Receptor for members of the ephrin-B family. The sequence for protein Ephrin type-B receptor 2 [precursor] is given at the end of the application, as "Ephrin type-B receptor 2 [precursor] amino acid sequence" (SEQ ID NO:1417). Known polymorphisms for this sequence are as shown in Table 23.

TABLE 23

Amino acid mutations for Known Protein

| SNP position(s) on amino acid sequence | Comment |
|---|---|
| 671 | A -> R. /FTId = VAR_004162. |
| 1-20 | MALRRLGAALLLLPLLAAVE -> MWVPVLALPVCTYA |
| 923 | E -> K |
| 956 | L -> V |
| 958 | V -> L |
| 154 | G -> D |
| 476 | K -> KQ |
| 495-496 | Missing |
| 532 | E -> D |
| 568 | R -> RR |
| 589 | M -> I |
| 788 | I -> F |
| 853 | S -> A |

Protein Ephrin type-B receptor 2 [precursor] (SEQ ID NO:1417) localization is believed to be Type I membrane protein.

The following GO Annotation(s) apply to the previously known protein. The following annotation(s) were found: protein amino acid phosphorylation; transmembrane receptor protein tyrosine kinase signaling pathway; neurogenesis, which are annotation(s) related to Biological Process; protein tyrosine kinase; receptor; transmembrane-ephrin receptor; ATP binding; transferase, which are annotation(s) related to Molecular Function; and integral membrane protein, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster M85491 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 9 refer to weighted expression of ESTs in each category, as "parts per million" (ratio of the expression of ESTs for a particular cluster to the expression of all ESTs in that category, according to parts per million).

Figure 9:
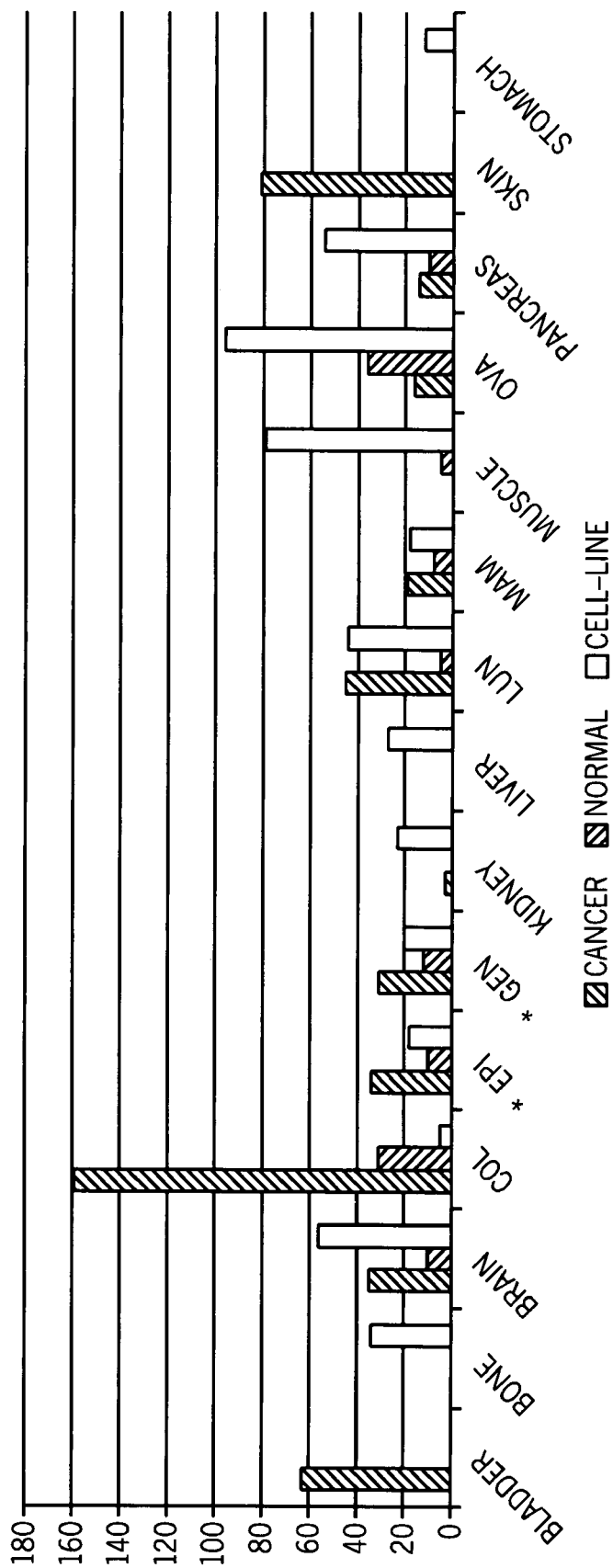
FIG. 9 is a histogram showing Cancer and cell-line vs. normal tissue expression for Cluster M85491, demonstrating overexpression in epithelial malignant tumors and a mixture of malignant tumors from different tissues.

Overall, the following results were obtained as shown with regard to the histograms in FIG. 9 and Table 24. This cluster is overexpressed (at least at a minimum level) in the following pathological conditions: epithelial malignant tumors and a mixture of malignant tumors from different tissues.

TABLE 24

Normal tissue distribution

| Name of Tissue | Number |
|---|---|
| Bladder | 0 |
| Bone | 0 |
| Brain | 10 |
| Colon | 31 |
| epithelial | 10 |

TABLE 24-continued

Normal tissue distribution

| Name of Tissue | Number |
| --- | --- |
| General | 12 |
| Kidney | 0 |
| Liver | 0 |
| Lung | 5 |
| Breast | 8 |
| Muscle | 5 |
| Ovary | 36 |
| pancreas | 10 |
| Skin | 0 |
| Stomach | 0 |

TABLE 25

P values and ratios for expression in cancerous tissue

| Name of Tissue | P1 | P2 | SP1 | R3 | SP2 | R4 |
| --- | --- | --- | --- | --- | --- | --- |
| Bladder | 5.4e-01 | 6.0e-01 | 3.2e-01 | 2.5 | 4.6e-01 | 1.9 |
| Bone | 1 | 2.8e-01 | 1 | 1.0 | 7.0e-01 | 1.8 |
| Brain | 3 4e-01 | 3.6e-01 | 1.2e-01 | 2.9 | 1.8e-02 | 2.7 |
| Colon | 3 4e-02 | 5.7e-02 | 8.2e-02 | 2.8 | 2.0e-01 | 2.1 |
| epithelial | 1.7e-03 | 3.5e-03 | 2.0e-03 | 2.8 | 1.1e-02 | 2.2 |
| General | 4.8e-04 | 5.2e-04 | 6.7e-04 | 2.3 | 1.3e-03 | 1.9 |
| Kidney | 4.3e-01 | 3.7e-01 | 1 | 1.1 | 7.0e-01 | 1.5 |
| Liver | 1 | 4.5e-01 | 1 | 1.0 | 6.9e-01 | 1.5 |
| Lung | 2.2e-01 | 2.7e-01 | 6.9e-02 | 3.6 | 3.4e-02 | 3.6 |
| Breast | 8.2e-01 | 7.3e-01 | 6.9e-01 | 1.2 | 6.8e-01 | 1.2 |
| Muscle | 9.2e-01 | 4.8e-01 | 1 | 0.8 | 1.5e-01 | 3.2 |
| Ovary | 8.5e-01 | 7.3e-01 | 9.0e-01 | 0.7 | 6.7e-01 | 1.0 |
| pancreas | 5.5e-01 | 2.0e-01 | 6.7e-01 | 1.2 | 3.5e-01 | 1.8 |
| Skin | 2.9e-01 | 4.7e-01 | 1.4e-01 | 7.0 | 6.4e-01 | 1.6 |
| Stomach | 1.5e-01 | 3.2e-01 | 1 | 1.0 | 8.0e-01 | 1.3 |

As noted above, cluster M85491 features 2 transcript(s), which were listed in Table 20 above. These transcript(s) encode for protein(s) which are variant(s) of protein Ephrin type-B receptor 2 [precursor] (SEQ ID NO:1417). A description of each variant protein according to the present invention is now provided.

Variant protein M85491_PEA_1_P13 (SEQ ID NO:1283) according to the present invention has an amino acid sequence as given at the end of the application; it is encoded by transcript(s) M85491_PEA_1_T16 (SEQ ID NO:3). An alignment is given to the known protein (Ephrin type-B receptor 2 [precursor] (SEQ ID NO:1417)) at the end of the application. One or more alignments to one or more previously published protein sequences are given at the end of the application. A brief description of the relationship of the variant protein according to the present invention to each such aligned protein is as follows:

Comparison report between M85491_PEA_1_P13 (SEQ ID NO:1283) and EPB2_HUMAN (SEQ ID NO:1417):

1. An isolated chimeric polypeptide encoding for M85491_PEA_1_P13 (SEQ ID NO:1283), comprising a first amino acid sequence being at least 90% homologous to MALRRLGAALLLLPLLAAVEETLMDSTTATAELGW-MVHPPSGWEEVSGYDENMNTIRTYQVCNVFESSQ-NNWL RTKFIRRRGAHRIHVEMKFSVRDCSSIPSVP-GSCKETFNLYYYEADFDSATKTFPNWMENPWVKV-DTIAADESFSQ VDLGGRVMKINTEVRSFGPVSRSG-FYLAFQDYGGCMSLIAVRVFYRKCPRIIQNGAIFQE-TLSGAESTSLVAARGSC IANAEEVDVPIKLYC-NGDGEWLVPIGRCMCKAGFEAVENGTVCRGCPSGT-FKANQGDEACTHCPINSRTTSEGAT NCVCRNGYY0-RADLDPLDMPCTTIPSAPQAVISSVNETSLMLEWTPP-RDSGGREDLVYNIICKSCGSGRGACTRCGD NVQYAPRQLGLTEPRIYISDLLAHTQYTFEIQAVNG-VTDQSPFSPQFASVNITTNQAAPSAVSIMHQVSR-TVDSITLS WSQPDQPNGVILDYELQYYEK corresponding to amino acids 1-476 of EPB2_HUMAN (SEQ ID NO:1417), which also corresponds to amino acids 1-476 of M85491_PEA_1_P13 (SEQ ID NO:1283), and a second amino acid sequence being at least 70%, optionally at least 80%, preferably at least 85%, more preferably at least 90% and most preferably at least 95% homologous to a polypeptide having the sequence VPIGWVLSPSPTSLRAPLPG (SEQ ID NO: 1755) corresponding to amino acids 477-496 of M85491_PEA_1_P13 (SEQ ID NO:1283), wherein said first and second amino acid sequences are contiguous and in a sequential order.

2. An isolated polypeptide encoding for a tail of M85491_PEA_1_P13 (SEQ ID NO:1283), comprising a polypeptide being at least 70%, optionally at least about 80%, preferably at least about 85%, more preferably at least about 90% and most preferably at least about 95% homologous to the sequence VPIGWVLSPSPTSLRAPLPG (SEQ ID NO: 1755) in M85491_PEA_1_P13 (SEQ ID NO:1283).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M85491_PEA_1_P13 (SEQ ID NO:1283) is encoded by the following transcript(s): M85491_PEA_1_T16 (SEQ ID NO:3), for which the sequence(s) is/are given at the end of the application. The coding portion of transcript M85491_PEA_1_T16 (SEQ ID NO:3) is shown in bold; this coding portion starts at position 143 and ends at position 1630. The transcript also has the following SNPs as listed in Table 26 (given according to their position on the nucleotide sequence, with the alternative nucleic acid listed; the last column indicates whether the SNP is known or not; the presence of known SNPs in variant protein M85491_PEA_1_P13 (SEQ ID NO:1283) sequence provides support for the deduced sequence of this variant protein according to the present invention).

TABLE 26

Nucleic acid SNPs

| SNP position on nucleotide sequence | Alternative nucleic acid | Previously known SNP? |
| --- | --- | --- |
| 799 | G -> A | Yes |
| 1066 | C -> T | Yes |
| 1519 | A -> G | Yes |
| 1872 | C -> T | Yes |
| 2044 | T -> C | Yes |
| 2156 | G -> A | Yes |
| 2606 | C -> A | Yes |
| 2637 | G -> C | Yes |

Variant protein M85491_PEA_1_P14 (SEQ ID NO:1284) according to the present invention has an amino acid sequence as given at the end of the application; it is encoded by transcript(s) M85491_PEA_1_T20 (SEQ ID NO:4). An alignment is given to the known protein (Ephrin type-B receptor 2 [precursor] (SEQ ID NO:1417)) at the end of the application. One or more alignments to one or more previously published protein sequences are given at the end of the application. A brief description of the relationship of the variant protein according to the present invention to each such aligned protein is as follows:

Comparison report between M85491_PEA_1_P14 (SEQ ID NO:1284) and EPB2_HUMAN (SEQ ID NO:1417):

1. An isolated chimeric polypeptide encoding for M85491_PEA_1_P14 (SEQ ID NO:1284), comprising a first amino acid sequence being at least 90% homologous to MALRRLGAALLLLPLLAAVEETLMDSTTATAELG-WMVHPPSGWEEVSGYDENMNTIRTYQVCNVFESSQ-NNWL RTKFIRRRGAHRIHVEMKFSVRDCSSIPSVPG-SCKETFNLYYYEADFDSATKTFPNWMENPWVKVD-TIAADESFSQ VDLGGRVMKINTEVRSFGPVSRSGFY-LAFQDYGGCMSLIAVRVFYRKCPRIIQNGAIFQETLS-GAESTSLVAARGSC IANAEEVDVPIKLYCNGDGEWL-VPIGRCMCKAGFEAVENGTVCR corresponding to amino acids 1-270 of EPB2_HUMAN (SEQ ID NO:1417), which also corresponds to amino acids 1-270 of M85491_PEA_1_P14 (SEQ ID NO:1284), and a second amino acid sequence being at least 70%, optionally at least 80%, preferably at least 85%, more preferably at least 90% and most preferably at least 95% homologous to a polypeptide having the sequence ERQDLTMLSRLVLNSWPQMILPPQPPKVLEL (SEQ ID NO:1756) corresponding to amino acids 271-301 of M85491_PEA_1_P14 (SEQ ID NO:1284), wherein said first and second amino acid sequences are contiguous and in a sequential order.

2. An isolated polypeptide encoding for a tail of M85491_PEA_1_P14 (SEQ ID NO:1284), comprising a polypeptide being at least 70%, optionally at least about 80%, preferably at least about 85%, more preferably at least about 90% and most preferably at least about 95% homologous to the sequence ERQDLTMLSRLVLNSWPQMILPPQPPKV-LEL (SEQ ID NO: 1756) in M85491_PEA_1_P14 (SEQ ID NO:1284).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M85491_PEA_1_P14 (SEQ ID NO:1284) is encoded by the following transcript(s): M85491_PEA_1_T20 (SEQ ID NO:4), for which the sequence(s) is/are given at the end of the application. The coding portion of transcript M85491_PEA_1_T20 (SEQ ID NO:4) is shown in bold; this coding portion starts at position 143 and ends at position 1045. The transcript also has the following SNPs as listed in Table 27 (given according to their position on the nucleotide sequence, with the alternative nucleic acid listed; the last column indicates whether the SNP is known or not; the presence of known SNPs in variant protein M85491_PEA_1_P14 (SEQ ID NO:1284) sequence provides support for the deduced sequence of this variant protein according to the present invention).

TABLE 27

Nucleic acid SNPs

| SNP position on nucleotide sequence | Alternative nucleic acid | Previously known SNP? |
|---|---|---|
| 799 | G -> A | Yes |
| 1135 | T -> C | Yes |
| 1160 | T -> C | Yes |
| 1172 | A -> C | Yes |
| 1176 | T -> A | Yes |

As noted above, cluster M85491 features 11 segment(s), which were listed in Table 21 above and for which the sequence(s) are given at the end of the application. These segment(s) are portions of nucleic acid sequence(s) which are described herein separately because they are of particular interest. A description of each segment according to the present invention is now provided.

Segment cluster M85491_PEA_1_node_0 (SEQ ID NO:1028) according to the present invention is supported by 5 libraries. The number of libraries was determined as previously described. This segment can be found in the following transcript(s): M85491_PEA_1_T16 (SEQ ID NO:3) and M85491_PEA_1 T20 (SEQ ID NO:4). Table 28 below describes the starting and ending position of this segment on each transcript.

TABLE 28

Segment location on transcripts

| Transcript name | Segment starting position | Segment ending position |
|---|---|---|
| M85491_PEA_1_T16 (SEQ ID NO:3) | 1 | 203 |
| M85491_PEA_1_T20 (SEQ ID NO:4) | 1 | 203 |

Segment cluster M85491_PEA_1_node_13 (SEQ ID NO:1029) according to the present invention is supported by 6 libraries. The number of libraries was determined as previously described. This segment can be found in the following transcript(s): M85491_PEA_1_T20 (SEQ ID NO:4). Table 29 below describes the starting and ending position of this segment on each transcript.

TABLE 29

Segment location on transcripts

| Transcript name | Segment starting position | Segment ending position |
|---|---|---|
| M85491_PEA_1_T20 (SEQ ID NO:4) | 954 | 1182 |

Segment cluster M85491_PEA_1_node_21 (SEQ ID NO:1030) according to the present invention is supported by 18 libraries. The number of libraries was determined as previously described. This segment can be found in the following transcript(s): M85491_PEA_1_T16 (SEQ ID NO:3). Table 30 below describes the starting and ending position of this segment on each transcript.

TABLE 30

Segment location on transcripts

| Transcript name | Segment starting position | Segment ending position |
|---|---|---|
| M85491_PEA_1_T16 (SEQ ID NO:3) | 1110 | 1445 |

Segment cluster M85491_PEA_1_node_23 (SEQ ID NO:1031) according to the present invention is supported by 18 libraries. The number of libraries was determined as previously described. This segment can be found in the following transcript(s): M85491_PEA_1_T16 (SEQ ID NO:3). Table 31 below describes the starting and ending position of this segment on each transcript.

TABLE 31

Segment location on transcripts

| Transcript name | Segment starting position | Segment ending position |
|---|---|---|
| M85491_PEA_1_T16 (SEQ ID NO:3) | 1446 | 1570 |

Segment cluster M85491_PEA_1_node_24 (SEQ ID NO:1032) according to the present invention is supported by 3 libraries. The number of libraries was determined as previously described. This segment can be found in the following transcript(s): M85491_PEA_1_T16 (SEQ ID NO:3). Table 32 below describes the starting and ending position of this segment on each transcript.

TABLE 32

Segment location on transcripts

| Transcript name | Segment starting position | Segment ending position |
|---|---|---|
| M85491_PEA_1_T16 (SEQ ID NO:3) | 1571 | 2875 |

Segment cluster M85491_PEA_1_node_8 (SEQ ID NO:1033) according to the present invention is supported by 25 libraries. The number of libraries was determined as previously described. This segment can be found in the following transcript(s): M85491_PEA_1_T16 (SEQ ID NO:3) and M85491_PEA_1_T20 (SEQ ID NO:4). Table 33 below describes the starting and ending position of this segment on each transcript.

TABLE 33

Segment location on transcripts

| Transcript name | Segment starting position | Segment ending position |
|---|---|---|
| M85491_PEA_1_T16 (SEQ ID NO:3) | 269 | 672 |
| M85491_PEA_1_T20 (SEQ ID NO:4) | 269 | 672 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 34.

TABLE 34

Oligonucleotides related to this segment

| Oligonucleotide name | Overexpressed in cancers | Chip reference |
|---|---|---|
| M85491_0_14_0 (SEQ ID NO:206) | lung malignant tumors | LUN |

Segment cluster M85491_PEA_1_node_9 (SEQ ID NO:1034) according to the present invention is supported by 20 libraries. The number of libraries was determined as previously described. This segment can be found in the following transcript(s): M85491_PEA_1_T16 (SEQ ID NO:3) and M85491_PEA_1_T20 (SEQ ID NO:4). Table 35 below describes the starting and ending position of this segment on each transcript.

TABLE 35

Segment location on transcripts

| Transcript name | Segment starting position | Segment ending position |
|---|---|---|
| M85491_PEA_1_T16 (SEQ ID NO:3) | 673 | 856 |
| M85491_PEA_1_T20 (SEQ ID NO:4) | 673 | 856 |

According to an optional embodiment of the present invention, short segments related to the above cluster are also provided. These segments are up to about 120 bp in length, and so are included in a separate description.

Segment cluster M85491_PEA_1_node_10 (SEQ ID NO:1035) according to the present invention is supported by 17 libraries. The number of libraries was determined as previously described. This segment can be found in the following transcript(s): M85491_PEA_1_T16 (SEQ ID NO:3) and M85491_PEA_1_T20 (SEQ ID NO:4). Table 36 below describes the starting and ending position of this segment on each transcript.

TABLE 36

Segment location on transcripts

| Transcript name | Segment starting position | Segment ending position |
|---|---|---|
| M85491_PEA_1_T16 (SEQ ID NO:3) | 857 | 953 |
| M85491_PEA_1_T20 (SEQ ID NO:4) | 857 | 953 |

Segment cluster M85491_PEA_1_node_18 (SEQ ID NO:1036) according to the present invention is supported by 15 libraries. The number of libraries was determined as previously described. This segment can be found in the following transcript(s): M85491_PEA_1_T16 (SEQ ID NO:3). Table 37 below describes the starting and ending position of this segment on each transcript.

TABLE 37

Segment location on transcripts

| Transcript name | Segment starting position | Segment ending position |
|---|---|---|
| M85491_PEA_1_T16 (SEQ ID NO:3) | 954 | 1044 |

Segment cluster M85491_PEA_1_node_19 (SEQ ID NO:1037) according to the present invention is supported by 15 libraries. The number of libraries was determined as previously described. This segment can be found in the following transcript(s): M85491_PEA_1_T16 (SEQ ID NO:3). Table 38 below describes the starting and ending position of this segment on each transcript.

TABLE 38

Segment location on transcripts

| Transcript name | Segment starting position | Segment ending position |
|---|---|---|
| M85491_PEA_1_T16 (SEQ ID NO:3) | 1045 | 1109 |

Segment cluster M85491_PEA_1_node_6 (SEQ ID NO:1038) according to the present invention is supported by 11 libraries. The number of libraries was determined as previously described. This segment can be found in the following transcript(s): M85491_PEA_1_T16 (SEQ ID NO:3) and M85491_PEA_1_T20 (SEQ ID NO:4). Table 39 below describes the starting and ending position of this segment on each transcript.

TABLE 39

Segment location on transcripts

| Transcript name | Segment starting position | Segment ending position |
|---|---|---|
| M85491_PEA_1_T16 (SEQ ID NO:3) | 204 | 268 |
| M85491_PEA_1_T20 (SEQ ID NO:4) | 204 | 268 |

Variant protein alignment to the previously known protein:

Sequence name: /tmp/qfmsU9VtxS/DylcLC9j8v: EPB2_HUMAN (SEQ ID NO:1417)

Sequence documentation:

Alignment of: M85491_PEA_1_P13 (SEQ ID NO:1283) x EPB2_HUMAN (SEQ ID NO:1417)

Alignment segment 1/1:

| | |
|---|---|
| Quality: 4726.00 | Escore: 0 |
| Matching length: 476 | Total length: 476 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MALRRLGAALLLLPLLAAVEETLMDSTTATAELGWMVHPPSGWEEVSGYD  50
    ||||||||||||||||||||||||||||||||||||||||||||||||||
  1 MALRRLGAALLLLPLLAAVEETLMDSTTATAELGWMVHPPSGWEEVSGYD  50

51 ENMNTIRTYQVCNVFESSQNNWLRTKFIRRRGAHRIHVEMKFSVRDCSSI 100
    ||||||||||||||||||||||||||||||||||||||||||||||||||
 51 ENMNTIRTYQVCNVFESSQNNWLRTKFIRRRGAHRIHVEMKFSVRDCSSI 100

101 PSVPGSCKETFNLYYYEADFDSATKTFPNWMENPWVKVDTIAADESFSQV 150
    ||||||||||||||||||||||||||||||||||||||||||||||||||
101 PSVPGSCKETFNLYYYEADFDSATKTFPNWMENPWVKVDTIAADESFSQV 150

151 DLGGRVMKINTEVRSFGPVSRSGFYLAFQDYGGCMCLIAVRVFYRKCPRI 200
    ||||||||||||||||||||||||||||||||||||||||||||||||||
151 DLGGRVMKINTEVRSFGPVSRSGFYLAFQDYGGCMCLIAVRVFYRKCPRI 200

201 IQNGAIFQETLSGAESTSLVAARGSCIANAEEVDVPIKLYCNGDGEWLVP 250
    ||||||||||||||||||||||||||||||||||||||||||||||||||
201 IQNGAIFQETLSGAESTSLVAARGSCIANAEEVDVPIKLYCNGDGEWLVP 250

251 IGRCMCKAGFEAVENGTVCRGCPSGTFKANQGDEACTHCPINSRTTSEGA 300
    ||||||||||||||||||||||||||||||||||||||||||||||||||
251 IGRCMCKAGFEAVENGTVCRGCPSGTFKANQGDEACTHCPINSRTTSEGA 300

301 TNCVCRNGYYRADLDPLDMPCTTIPSAPQAVISSVNETSLMLEWTPPRDS 350
    ||||||||||||||||||||||||||||||||||||||||||||||||||
301 TNCVCRNGYYRADLDPLDMPCTTIPSAPQAVISSVNETSLMLEWTPPRDS 350

351 GGREDLVYNIICKSCGSGRGACTRCGDNVQYAPRQLGLTEPRIYISDLLA 400
    ||||||||||||||||||||||||||||||||||||||||||||||||||
351 GGREDLVYNIICKSCGSGRGACTRCGDNVQYAPRQLGLTEPRIYISDLLA 400

401 HTQYTFEIQAVNGVTDQSPFSPQFASVNITTNQAAPSAVSIMHQVSRTVD 450
    ||||||||||||||||||||||||||||||||||||||||||||||||||
401 HTQYTFEIQAVNGVTDQSPFSPQFASVNITTNQAAPSAVSIMHQVSRTVD 450
```

```
451 SITLSWSQPDQPNGVILDYELQYYEK                                   476
    |||||||||||||||||||||||||
451 SITLSWSQPDQPNGVILDYELQYYEK                                   476
```

Sequence name: /tmp/rmnzuDbot6/GiHbjeU81R: EPB2_HUMAN (SEQ ID NO:1417)

Sequence documentation:

Alignment of: M85491_PEA__1_P14 (SEQ ID NO:1284) x EPB2_HUMAN (SEQ ID NO:1417) . . .

Alignment segment 1/1:

| | |
|---|---|
| Quality: 2673.00 | Escore: 0 |
| Matching length: 270 | Total length: 270 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MALRRLGAALLLLPLLAAVEETLMDSTTATAELGWMVHPPSGWEEVSGYD  50
    ||||||||||||||||||||||||||||||||||||||||||||||||||
  1 MALRRLGAALLLLPLLAAVEETLMDSTTATAELGWMVHPPSGWEEVSGYD  50

51 ENMNTIRTYQVCNVFESSQNNWLRTKFIRRRGAHRIHVEMKFSVRDCSSI 100
    |||||||||||||||||||||||||||||||||||||||||||||||||
 51 ENMNTIRTYQVCNVFESSQNNWLRTKFIRRRGAHRIHVEMKFSVRDCSSI 100

101 PSVPGSCKETFNLYYYEADFDSATKTFPNWMENPWVKVDTIAADESFSQV 150
    |||||||||||||||||||||||||||||||||||||||||||||||||
101 PSVPGSCKETFNLYYYEADFDSATKTFPNWMENPWVKVDTIAADESFSQV 150

151 DLGGRVMKINTEVRSFGPVSRSGFYLAFQDYGGCMCLIAVRVFYRKCPRI 200
    |||||||||||||||||||||||||||||||||||||||||||||||||
151 DLGGRVMKINTEVRSFGPVSRSGFYLAFQDYGGCMCLIAVRVFYRKCPRI 200

201 IQNGAIFQETLSGAESTSLVAARGSCIANAEEVDVPIKLYCNGDGEWLVP 250
    |||||||||||||||||||||||||||||||||||||||||||||||||
201 IQNGAIFQETLSGAESTSLVAARGSCIANAEEVDVPIKLYCNGDGEWLVP 250

251 IGRCMCKAGFEAVENGTVCR                                 270
    ||||||||||||||||||||
251 IGRCMCKAGFEAVENGTVCR                                 270
```

Expression of Ephrin Type-B Receptor 2 Precursor (EC 2.7.1.112) (Tyrosine-Protein Kinase Receptor EPH-3) M85491 Transcripts which are Detectable by Amplicon as Depicted in Sequence Name M85491seg24 (SEQ ID NO:1639) in Normal and Cancerous Lung Tissues Expression of Ephrin type-B receptor 2 precursor (EC 2.7.1.112) (Tyrosine-protein kinase receptor EPH-3) transcripts detectable by or according to seg24, M85491seg24 amplicon (SEQ ID NO:1639) and M85491seg24F (SEQ ID NO:1637) and M85491seg24R (SEQ ID NO:1638) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 above, "Tissue samples in testing panel"), to obtain a value of fold up-regulation for each sample relative to median of the normal PM samples.

Figure 10:
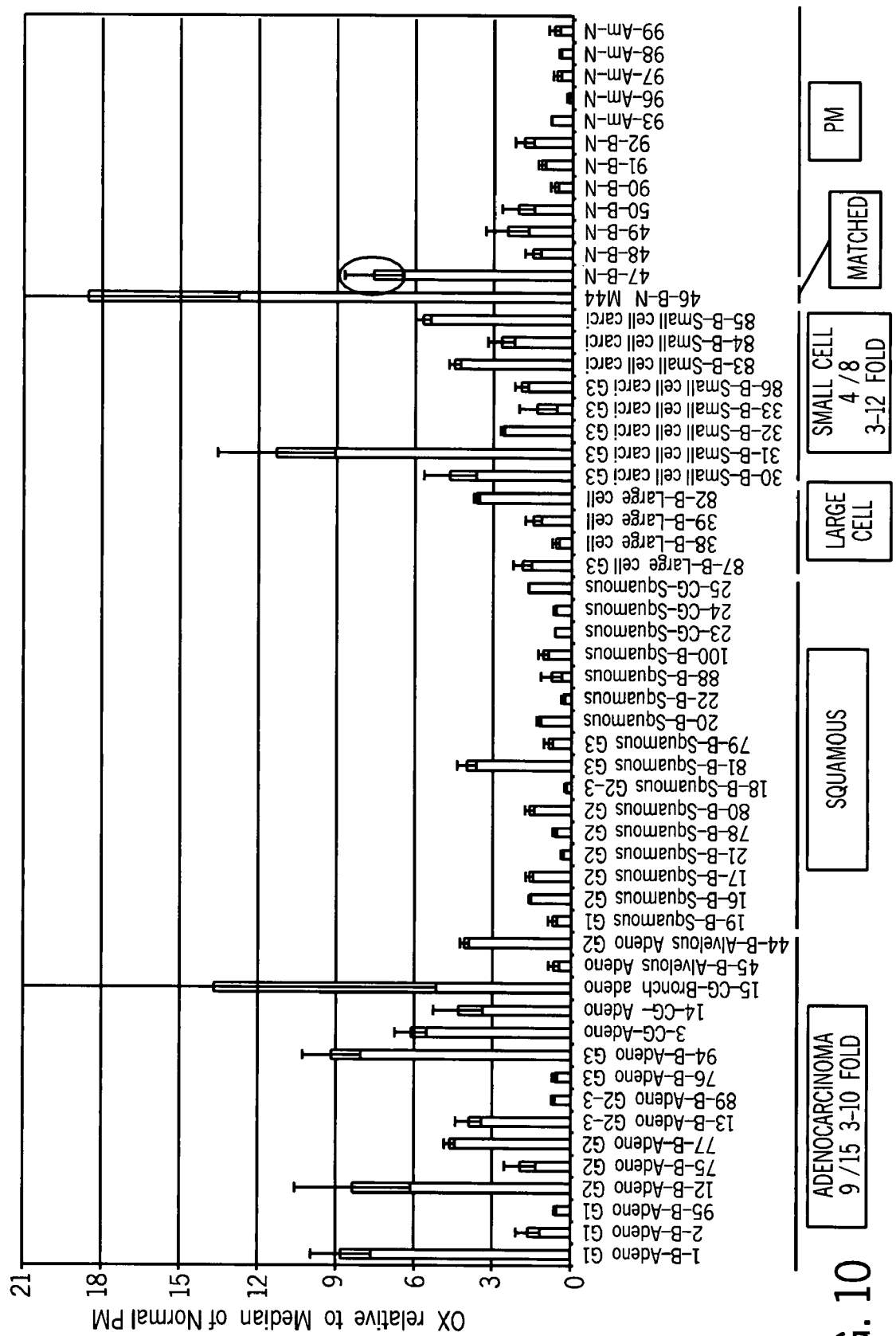
FIG. 10 is a histogram showing over expression of the above-indicated Ephrin type-B receptor 2 precursor M85491 transcripts, which are detectable by amplicon as depicted in sequence name M85491seg24 (SEQ ID NO:1639), in cancerous lung samples relative to the normal samples.

FIG. 10 below is a histogram showing over expression of the above-indicated Ephrin type-B receptor 2 precursor (EC 2.7.1.112) (Tyrosine-protein kinase receptor EPH-3) transcripts in cancerous lung samples relative to the normal samples. Values represent the average of duplicate experiments. Error bars indicate the minimal and maximal values obtained. The number and percentage of samples that exhibit at least 3 fold over-expression, out of the total number of samples tested, is indicated in the bottom.

As is evident from FIG. 10, the expression of Ephrin type-B receptor 2 precursor (EC 2.7.1.112) (Tyrosine-protein kinase receptor EPH-3) transcripts detectable by the above ampliconin cancer samples was significantly higher than in the non-cancerous samples (Sample Nos. 47-50, 90-93, 96-99 Table 2, "Tissue samples in testing panel".). Notably an over-expression of at least 3 fold was found in 9 out of 15 adenocarcinoma samples and in 4 out of 8 small cell carcinoma samples.

Statistical analysis was applied to verify the significance of these results, as described below.

Threshold of 3 fold overexpression was found to differentiate between cancer and normal samples with P value of 7.42E-03 in adenocarcinoma and 5.69E-02 in small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: M85491seg24F forward primer (SEQ ID NO:1637); and M85491seg24Rreverse primer (SEQ ID NO:1638).

The present invention also preferably encompasses any amplicon obtained through the use of any suitable primer pair; for example, for the above experiment, the following amplicon was obtained as a non-limiting illustrative example only of a suitable amplicon: M85491seg24 (SEQ ID NO:1639)

M85491seg24F (SEQ ID NO:1637)—GGCGTCTTTCTC-CCTCTGAAC

M85491seg24R (SEQ ID NO:1638)—GTCCCAT-TCTGGGTGCTGTG

M85491seg24 (SEQ ID NO:1639)—GGCGTCTTTCTC-CCTCTGAACCTCAGTTTCCACCTGTGTCGAGTGT-GGGTGAGACCCCTCGCGGGGAGCTATG CAGGT-TACGGAGAAAAGGCAGCACAGCACCCAGAATGGG-AC Expression of Ephrin Type-B Receptor 2 Precursor (EC 2.7.1.112) (Tyrosine-Protein Kinase Receptor EPH-3) M85491 Transcripts which are Detectable by Amplicon as Depicted in Sequence Name M85491seg24 (SEQ ID NO:1639) in Different Normal Tissues Expression of Ephrin type-B receptor 2 precursor transcripts detectable by or according to M85491 seg24 amplicon (SEQ ID NO:1639) and M85491 seg24F (SEQ ID NO:1637) and M85491 seg24R (SEQ ID NO:1638) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17, Table 2, "Tissue sample on normal panel", above), to obtain a value of relative expression of each sample relative to median of the lung samples.

M85491seg24F (SEQ ID NO:1637)—GGCGTCTTTCTC-CCTCTGAAC

M85491seg24R (SEQ ID NO:1638)—GTCCCAT-TCTGGGTGCTGTG

Figure 11:
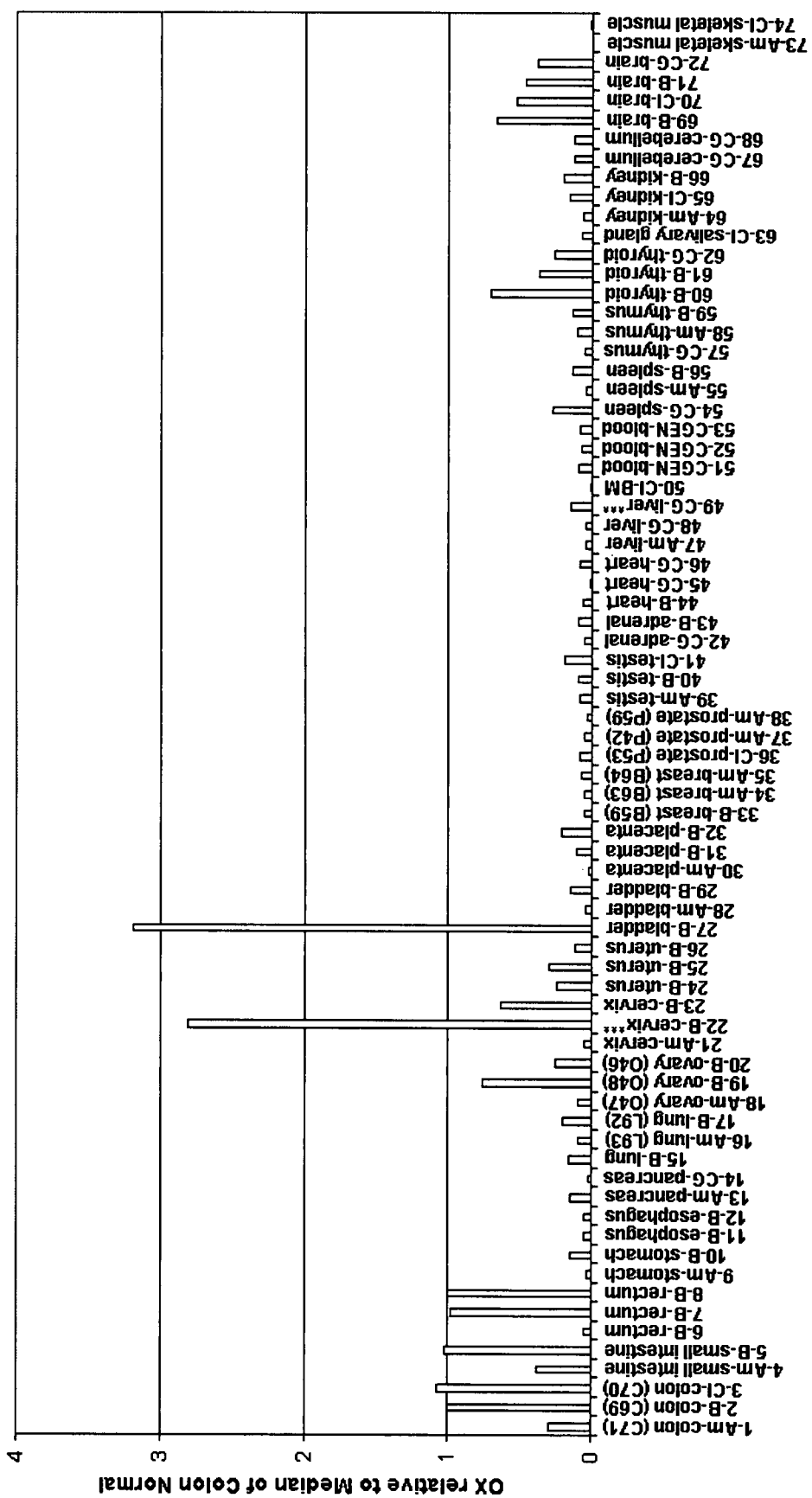
FIG. 11 is a histogram showing the expression of Ephrin type-B receptor 2 precursor (Tyrosine-protein kinase receptor EPH-3) M85491 transcripts which are detectable by amplicon as depicted in sequence name M85491seg24 (SEQ ID NO:1639) in different normal tissues.

M85491seg24 (SEQ ID NO:1639)—GGCGTCTTTCTC-CCTCTGAACCTCAGTTTCCACCTGTGTC-GAGTGTGGGTGAGACCCCTCGCGGGGAGCTATG CAGGTTACGGAGAAAAGGCAGCACAG-CACCCAGAATGGGAC The results are shown in FIG. 11, demonstrating the expression of Ephrin type-B receptor 2 precursor (Tyrosine-protein kinase receptor EPH-3) M85491 transcripts which are detectable by amplicon as depicted in sequence name M85491seg24 (SEQ ID NO:1639) in different normal tissues.

Description for Cluster T39971

Cluster T39971 features 4 transcript(s) and 28 segment(s) of interest, the names for which are given in Tables 40 and 41, respectively, the sequences themselves are given at the end of the application. The selected protein variants are given in table 42.

TABLE 40

Transcripts of interest

| Transcript Name | Sequence ID No. |
|---|---|
| T39971_T10 | 5 |
| T39971_T12 | 6 |
| T39971_T16 | 7 |
| T39971_T5 | 8 |

TABLE 41

Segments of interest

| Segment Name | Sequence ID No. |
|---|---|
| T39971_node_0 | 168 |
| T39971_node_18 | 169 |
| T39971_node_21 | 170 |
| T39971_node_22 | 171 |
| T39971_node_23 | 172 |
| T39971_node_31 | 173 |
| T39971_node_33 | 174 |
| T39971_node_7 | 175 |
| T39971_node_1 | 176 |
| T39971_node_10 | 177 |
| T39971_node_11 | 178 |
| T39971_node_12 | 179 |
| T39971_node_15 | 180 |
| T39971_node_16 | 181 |
| T39971_node_17 | 182 |
| T39971_node_26 | 183 |
| T39971_node_27 | 184 |
| T39971_node_28 | 185 |
| T39971_node_29 | 186 |
| T39971_node_3 | 187 |
| T39971_node_30 | 188 |
| T39971_node_34 | 189 |
| T39971_node_35 | 190 |
| T39971_node_36 | 191 |
| T39971_node_4 | 192 |
| T39971_node_5 | 193 |
| T39971_node_8 | 194 |
| T39971_node_9 | 195 |

TABLE 42

Proteins of interest

| Protein Name | Sequence ID No. |
|---|---|
| T39971_P6 | 1285 |
| T39971_P9 | 1286 |
| T39971_P11 | 1287 |
| T39971_P12 | 1288 |

These sequences are variants of the known protein Vitronectin precursor (SwissProt accession identifier VTNC_HUMAN; known also according to the synonyms Serum spreading factor; S-protein; V75), SEQ ID NO:1418, referred to herein as the previously known protein.

Protein Vitronectin precursor (SEQ ID NO:1418) is known or believed to have the following function(s): Vitronectin is a cell adhesion and spreading factor found in serum and tissues. Vitronectin interacts with glycosaminoglycans and proteoglycans. Is recognized by certain members of the integrin family and serves as a cell-to-substrate adhesion molecule.

Inhibitor of the membrane-damaging effect of the terminal cytolytic complement pathway. The sequence for protein Vitronectin precursor is given at the end of the application, as "Vitronectin precursor amino acid sequence". Known polymorphisms for this sequence are as shown in Table 4.

TABLE 43

Amino acid mutations for Known Protein

| SNP position(s) on amino acid sequence | Comment |
|---|---|
| 122 | A -> S./FTId = VAR_012983. |
| 268 | R -> Q./FTId = VAR_012984. |
| 400 | T -> M./FTId = VAR_012985. |
| 50 | C -> N |
| 225 | S -> N |
| 366 | A -> T |

Protein Vitronectin precursor (SEQ ID NO:1418) localization is believed to be Extracellular.

The previously known protein also has the following indication(s) and/or potential therapeutic use(s): Cancer, melanoma. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Alphavbeta3 integrin antagonist; Apoptosis agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: immune response; cell adhesion, which are annotation(s) related to Biological Process; protein binding; heparin binding, which are annotation(s) related to Molecular Function; and extracellular space, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster T39971 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 12 refer to weighted expression of ESTs in each category, as "parts per million" (ratio of the expression of ESTs for a particular cluster to the expression of all ESTs in that category, according to parts per million).

Figure 12:
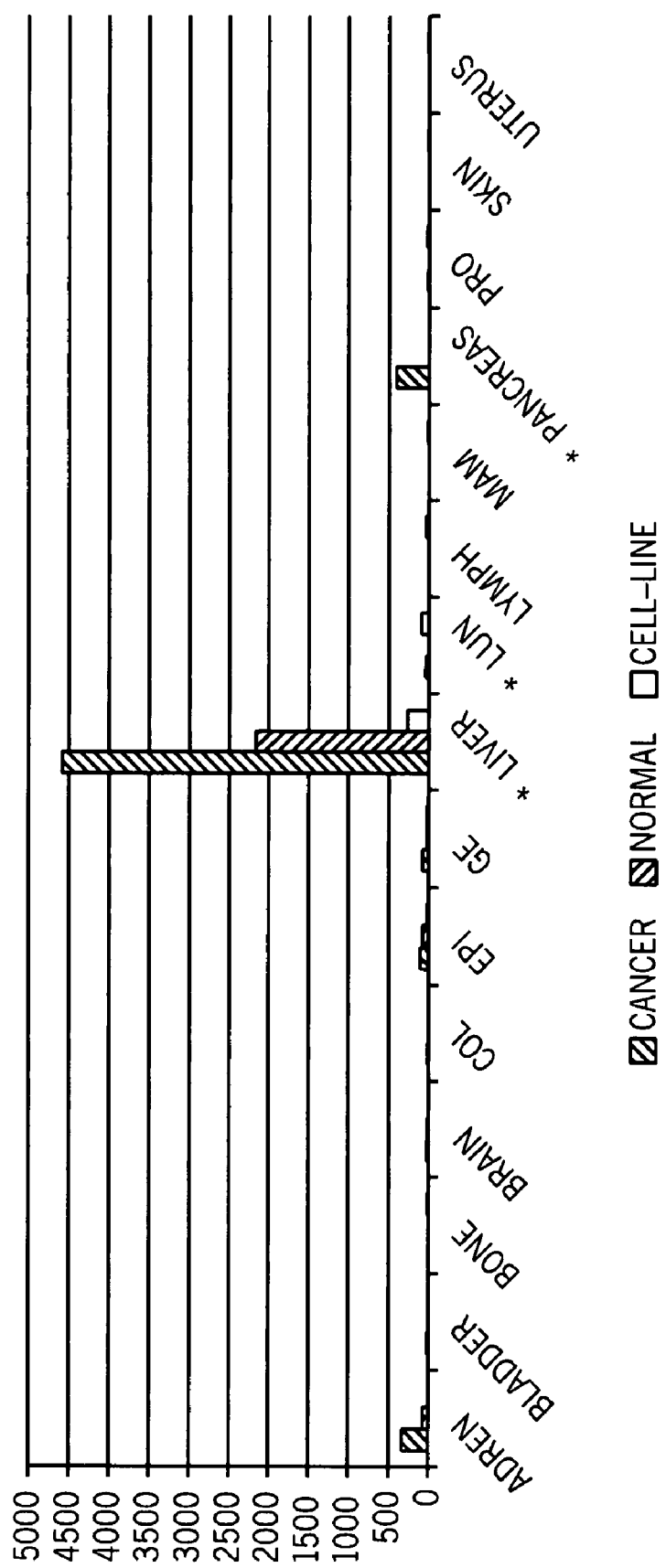
FIG. 12 is a histogram showing Cancer and cell-line vs. normal tissue expression for Cluster T39971, demonstrating overexpression in liver cancer, lung malignant tumors and pancreas carcinoma.

Overall, the following results were obtained as shown with regard to the histograms in FIG. 12 and Table 44. This cluster is overexpressed (at least at a minimum level) in the following pathological conditions: liver cancer, lung malignant tumors and pancreas carcinoma.

TABLE 44

Normal tissue distribution

| Name of Tissue | Number |
|---|---|
| adrenal | 60 |
| bladder | 0 |

TABLE 44-continued

Normal tissue distribution

| Name of Tissue | Number |
|---|---|
| Bone | 0 |
| Brain | 9 |
| Colon | 0 |
| epithelial | 79 |
| general | 29 |
| Liver | 2164 |
| Lung | 0 |
| Lymph nodes | 0 |
| Breast | 0 |
| pancreas | 0 |
| prostate | 0 |
| Skin | 0 |
| Uterus | 0 |

TABLE 45

P values and ratios for expression in cancerous tissue

| Name of Tissue | P1 | P2 | SP1 | R3 | SP2 | R4 |
|---|---|---|---|---|---|---|
| adrenal | 6.9e-01 | 7.4e-01 | 2.0e-02 | 2.3 | 5.3e-02 | 1.8 |
| bladder | 5.4e-01 | 6.0e-01 | 5.6e-01 | 1.8 | 6.8e-01 | 1.5 |
| Bone | 1 | 6.7e-01 | 1 | 1.0 | 7.0e-01 | 1.4 |
| Brain | 8.0e-01 | 8.6e-01 | 3.0e-01 | 1.9 | 5.3e-01 | 1.2 |
| Colon | 4.2e-01 | 4.8e-01 | 7.0e-01 | 1.6 | 7.7e-01 | 1.4 |
| epithelial | 6.6e-01 | 5.7e-01 | 1.0e-01 | 0.8 | 8.7e-01 | 0.6 |
| general | 5.1e-01 | 3.8e-01 | 9.2e-08 | 1.6 | 8.3e-04 | 1.3 |
| Liver | 1 | 6.7e-01 | 2.3e-03 | 0.3 | 1 | 0.2 |
| Lung | 2.4e-01 | 9.1e-02 | 1.7e-01 | 4.3 | 8.1e-03 | 5.0 |
| Lymph nodes | 1 | 5.7e-01 | 1 | 1.0 | 5.8e-01 | 2.3 |
| Breast | 1 | 6.7e-01 | 1 | 1.0 | 8.2e-01 | 1.2 |
| pancreas | 9.5e-02 | 1.8e-01 | 1.5e-11 | 6.5 | 8.2e-09 | 4.6 |
| prostate | 7.3e-01 | 6.0e-01 | 6.7e-01 | 1.5 | 5.6e-01 | 1.7 |
| Skin | 1 | 4.4e-01 | 1 | 1.0 | 6.4e-01 | 1.6 |
| Uterus | 5.0e-01 | 2.6e-01 | 1 | 1.1 | 8.0e-01 | 1.4 |

As noted above, cluster T39971 features 4 transcript(s), which were listed in Table 40 above. These transcript(s) encode for protein(s) which are variant(s) of protein Vitronectin precursor (SEQ ID NO:1418). A description of each variant protein according to the present invention is now provided.

Variant protein T39971_P6 (SEQ ID NO:1285) according to the present invention has an amino acid sequence as given at the end of the application; it is encoded by transcript(s) T39971_T5 (SEQ ID NO:8). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison report between T39971_P6 (SEQ ID NO:1285) and VTNC_HUMAN (SEQ ID NO:1418):

1. An isolated chimeric polypeptide encoding for T39971_P6 (SEQ ID NO:1285), comprising a first amino acid sequence being at least 90% homologous to MAPLR-PLLILALLAWVALADQESCKGRCTEGFNVDKKCQC-DELCSYYQSCCTDYTAECKPQVTRGDVFTMPEDE YTVYDDGEEKNNATVHEQVGGPSLTSDLQAQSKG-NPEQTPVLKPEEEAPAPEVGASKPEGIDSRPETLHPG-RPQPP AEEELCSGKPFDAFTDLKNGSLFAFRGQYC-YELDEKAVRPGYPKLIRDVWGIEGPIDAAFTRINCQ-GKTYLFKGSQ YWRFEDGVLDPDYPRNISDGFDGIPD-NVDAALALPAHSYSGRERVYFFKG corresponding to amino acids 1-276 of VTNC_HUMAN (SEQ ID NO:1418), which also corresponds to amino acids 1-276 of T39971_P6 (SEQ ID NO:1285), and a second amino acid sequence being at least 70%, optionally at least 80%, preferably at least 85%, more preferably at least 90% and most preferably at least 95% homologous to a polypeptide having the sequence TQGVVGD (SEQ ID NO: 1757) corresponding to amino acids 277-283 of T39971_P6 (SEQ ID NO:1285), wherein said first and second amino acid sequences are contiguous and in a sequential order.

2. An isolated polypeptide encoding for a tail of T39971_P6 (SEQ ID NO:1285), comprising a polypeptide being at least 70%, optionally at least about 80%, preferably at least about 85%, more preferably at least about 90% and most preferably at least about 95% homologous to the sequence TQGVVGD (SEQ ID NO:1757) in T39971_P6 (SEQ ID NO:1285).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P6 (SEQ ID NO:1285) also has the following non-silent SNPs (Single Nucleotide Polymorphisms) as listed in Table 46, (given according to their position(s) on the amino acid sequence, with the alternative amino acid(s) listed; the last column indicates whether the SNP is known or not; the presence of known SNPs in variant protein T39971_P6 (SEQ ID NO:1285) sequence provides support for the deduced sequence of this variant protein according to the present invention).

TABLE 46

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 280 | V -> A | Yes |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P6 (SEQ ID NO:1285) is encoded by the following transcript(s): T39971_T5 (SEQ ID NO:8), for which the sequence(s) is/are given at the end of the application. The coding portion of transcript T39971_T5 (SEQ ID NO:8) is shown in bold; this coding portion starts at position 756 and ends at position 1604. The transcript also has the following SNPs as listed in Table 47 (given according to their position on the nucleotide sequence, with the alternative nucleic acid listed; the last column indicates whether the SNP is known or not; the presence of known SNPs in variant protein T39971_P6 (SEQ ID NO:1285) sequence provides support for the deduced sequence of this variant protein according to the present invention).

TABLE 47

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1594 | T -> C | Yes |
| 1642 | T -> C | Yes |
| 1770 | C -> T | Yes |
| 529 | G -> T | Yes |
| 1982 | A -> G | No |
| 2007 | G -> | No |
| 2029 | T -> C | No |
| 2094 | T -> C | No |
| 2117 | C -> G | No |
| 2123 | C -> T | Yes |
| 2152 | C -> T | Yes |
| 2182 | G -> T | No |
| 2185 | A -> C | No |
| 2297 | T -> C | Yes |
| 1119 | G -> T | Yes |
| 2411 | G -> | No |
| 2411 | G -> T | No |
| 2487 | T -> C | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P9 (SEQ ID NO:1286) according to the present invention has an amino acid sequence as given at the end of the application; it is encoded by transcript(s) T39971_T10 (SEQ ID NO:5). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison report between T39971_P9 (SEQ ID NO:1286) and VTNC_HUMAN (SEQ ID NO:1418):

1. An isolated chimeric polypeptide encoding for T39971_P9 (SEQ ID NO:1286), comprising a first amino acid sequence being at least 90% homologous to MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPP AEEELCSGKPFDAFTDLKNGSLFAFRGQYCYELDEKAVRPGYPKLIRDVWGIEGPIDAAFTRINCQGKTYLFKGSQ YWRFEDGVLDPDYPRNISDGFDGIPDNVDAALALPAHSYSGRERVYFFKGKQYWEYQFQHQPSQEECEGSSLSAV FEHFAMMQRDSWEDIFELLFWGRT corresponding to amino acids 1-325 of VTNC_HUMAN (SEQ ID NO:1418), which also corresponds to amino acids 1-325 of T39971_P9 (SEQ ID NO:1286), and a second amino acid sequence being at least 90% homologous to SGMAPRPSLAKKQRFRHRNRKGYRSQRGHSRGRNQNSRRPSRATWLSLFSSEESNLGANNYDDYRMDWLVPATC EPIQSVFFFSGDKYYRVNLRTRRVDTVDPPYPRSIA- QYWLGCPAPGHL corresponding to amino acids 357-478 of VTNC_HUMAN (SEQ ID NO:1418), which also corresponds to amino acids 326-447 of T39971_P9 (SEQ ID NO:1286), wherein said first and second amino acid sequences are contiguous and in a sequential order.

2. An isolated chimeric polypeptide encoding for an edge portion of T39971_P9 (SEQ ID NO:1286), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TS, having a structure as follows: a sequence starting from any of amino acid numbers 325-x to 325; and ending at any of amino acid numbers 326+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P9 (SEQ ID NO:1286) also has the following non-silent SNPs (Single Nucleotide Polymorphisms) as listed in Table 48, (given according to their position(s) on the amino acid sequence, with the alternative amino acid(s) listed; the last column indicates whether the SNP is known or not; the presence of known SNPs in variant protein T39971_P9 (SEQ ID NO:1286) sequence provides support for the deduced sequence of this variant protein according to the present invention).

TABLE 48

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 328 | M -> T | No |
| 350 | S -> P | No |
| 369 | T -> M | Yes |
| 379 | S -> I | No |
| 380 | N -> T | No |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P9 (SEQ ID NO:1286) is encoded by the following transcript(s): T39971_T10 (SEQ ID NO:5), for which the sequence(s) is/are given at the end of the application. The coding portion of transcript T39971_T10 (SEQ ID NO:5) is shown in bold; this coding portion starts at position 756 and ends at position 2096. The transcript also has the following SNPs as listed in Table 49 (given according to their position on the nucleotide sequence, with the alternative nucleic acid listed; the last column indicates whether the SNP is known or not; the presence of known SNPs in variant protein T39971_P9 (SEQ ID NO:1286) sequence provides support for the deduced sequence of this variant protein according to the present invention).

TABLE 49

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1738 | T -> C | No |
| 1803 | T -> C | No |
| 1826 | C -> G | No |
| 529 | G -> T | Yes |
| 1832 | C -> T | Yes |
| 1861 | C -> T | Yes |
| 1891 | G -> T | No |
| 1894 | A -> C | No |
| 2006 | T -> C | Yes |
| 2120 | G -> | No |
| 2120 | G -> T | No |
| 2196 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P11 (SEQ ID NO:1287) according to the present invention has an amino acid sequence as given at the end of the application; it is encoded by transcript(s) T39971_T12 (SEQ ID NO:6). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison report between T39971_P11 (SEQ ID NO:1287) and VTNC_HUMAN (SEQ ID NO:1418):

1. An isolated chimeric polypeptide encoding for T39971_P11 (SEQ ID NO:1287), comprising a first amino acid sequence being at least 90% homologous to MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPP AEEELCSGKPFDAFTDLKNGSLFAFRGQYCYELDEKAVRPGYPKLIRDVWGIEGPIDAAFTRINCQGKTYLFKGSQ YWRFEDGVLDPDYPRNISDGFDGIPDNVDAALALPAHSYSGRERVYFFKGKQYWEYQFQHQPSQEECEGSSLSAV FEHFAMMQRDSWEDIFELLFWGRTS corresponding to amino acids 1-326 of VTNC_HUMAN (SEQ ID NO:1418), which also corresponds to amino acids 1-326 of T39971_P11 (SEQ ID NO:1287), and a second amino acid sequence being at least 90% homologous to DKYYRVNLRTRRVDTVDPPYPRSIAQYWLGCPAPGHL corresponding to amino acids 442-478 of VTNC_HUMAN (SEQ ID NO:1418), which also corresponds to amino acids 327-363 of T39971_P11 (SEQ ID NO:1287), wherein said first and second amino acid sequences are contiguous and in a sequential order.

2. An isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)−x), in which x varies from 0 to n−2.

Comparison report between T39971_P11 (SEQ ID NO:1287) and Q9BSH7 (SEQ ID NO:1696):

1. An isolated chimeric polypeptide encoding for T39971_P11 (SEQ ID NO:1287), comprising a first amino acid sequence being at least 90% homologous to MAPLR-PLLILALLAWVALADQESCKGRCTEGFNVDKKCQC-DELCSYYQSCCTDYTAECKPQVTRGDVFTMPEDE YTVYDDGEEKNNATVHEQVGGPSLTSDLQAQSK-GNPEQTPVLKPEEEAPAPEVGASKPEGIDSRPETLH-PGRPQPP AEEELCSGKPFDAFTDLKNGSLFAFRGQY-CYELDEKAVRPGYPKLIRDVWGIEGPIDAAFTRINCQ-GKTYLFKGSQ YWRFEDGVLDPDYPRNISDGFDGIPD-NVDAALALPAHSYSGRERVYFFKGKQYWEYQFQH-QPSQEECEGSSLSAV FEHFAMMQRDSWEDIFELLF-WGRTS corresponding to amino acids 1-326 of Q9BSH7, which also corresponds to amino acids 1-326 of T39971_P11 (SEQ ID NO:1287), and a second amino acid sequence being at least 90% homologous to DKYYRVNLRTRRVDTVDP-PYPRSIAQYWLGCPAPGHL corresponding to amino acids 442-478 of Q9BSH7, which also corresponds to amino acids 327-363 of T39971_P11 (SEQ ID NO:1287), wherein said first and second amino acid sequences are contiguous and in a sequential order.

2. An isolated chimeric polypeptide encoding for an edge portion of T39971_P11 (SEQ ID NO:1287), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise SD, having a structure as follows: a sequence starting from any of amino acid numbers 326-x to 326; and ending at any of amino acid numbers 327+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P11 (SEQ ID NO:1287) also has the following non-silent SNPs (Single Nucleotide Polymorphisms) as listed in Table 50, (given according to their position(s) on the amino acid sequence, with the alternative amino acid(s) listed; the last column indicates whether the SNP is known or not; the presence of known SNPs in variant protein T39971_P11 (SEQ ID NO:1287) sequence provides support for the deduced sequence of this variant protein according to the present invention).

TABLE 50

Amino acid mutations

| SNP position(s) on amino acid sequence | Alternative amino acid(s) | Previously known SNP? |
|---|---|---|
| 122 | A -> S | Yes |
| 145 | G -> | No |
| 268 | R -> Q | Yes |
| 180 | C -> | No |
| 180 | C -> W | No |
| 192 | Y -> | No |
| 209 | A -> | No |
| 211 | T -> | No |
| 267 | G -> | No |
| 267 | G -> A | No |
| 268 | R -> | No |

Variant protein T39971_P11 (SEQ ID NO:1287) is encoded by the following transcript(s): T39971_T12 (SEQ ID NO:6), for which the sequence(s) is/are given at the end of the application. The coding portion of transcript T39971_T12 (SEQ ID NO:6) is shown in bold; this coding portion starts at position 756 and ends at position 1844. The transcript also has the following SNPs as listed in Table 51 (given according to their position on the nucleotide sequence, with the alternative nucleic acid listed; the last column indicates whether the SNP is known or not; the presence of known SNPs in variant protein T39971_P11 (SEQ ID NO:1287) sequence provides support for the deduced sequence of this variant protein according to the present invention).

TABLE 51

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 1555 | G -> | No |
| 1555 | G -> C | No |
| 1558 | G -> | No |
| 1558 | G -> A | Yes |
| 1754 | T -> C | Yes |
| 1868 | G -> | No |
| 1868 | G -> T | No |
| 529 | G -> T | Yes |
| 1944 | T -> C | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

Variant protein T39971_P12 (SEQ ID NO:1288) according to the present invention has an amino acid sequence as given at the end of the application; it is encoded by transcript(s) T39971_T16 (SEQ ID NO:7). An alignment is given to the known protein (Vitronectin precursor (SEQ ID NO:1418)) at the end of the application. One or more alignments to one or more previously published protein sequences are given at the end of the application. A brief description of the relationship of the variant protein according to the present invention to each such aligned protein is as follows:

Comparison report between T39971_P12 (SEQ ID NO:1288) and VTNC_HUMAN (SEQ ID NO:1418):

1. An isolated chimeric polypeptide encoding for T39971_P12 (SEQ ID NO:1288), comprising a first amino acid sequence being at least 90% homologous to MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGPEQTPVLKPEEEAPAPEVGASKPEGIDSRPETLHPGRPQPP AEEELCSGKPFDAFTDLKNGSLFAFRGQYCYELDEKAVRPGYPKLIRDVWGIEGPIDAAFTRINCQGKTYLFK corresponding to amino acids 1-223 of VTNC_HUMAN (SEQ ID NO:1418), which also corresponds to amino acids 1-223 of T39971_P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO: 1758) corresponding to amino acids 224-238 of T39971_P12 (SEQ ID NO:1288), wherein said first and second amino acid sequences are contiguous and in a sequential order.

2. An isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

Comparison report between T39971_P12 (SEQ ID NO:1288) and Q9BSH7:

1. An isolated chimeric polypeptide encoding for T39971_P12 (SEQ ID NO:1288), comprising a first amino acid sequence being at least 90% homologous to MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPP AEEELCSGKPFDAFTDLKNGSLFAFRGQYCYELDEKAVRPGYPKLIRDVWGIEGPIDAAFTRINCQGKTYLFK corresponding to amino acids 1-223 of Q9BSH7, which also corresponds to amino acids 1-223 of T39971 P12 (SEQ ID NO:1288), and a second amino acid sequence being at least 70%, optionally at least 80%, preferably at least 85%, more preferably at least 90% and most preferably at least 95% homologous to a polypeptide having the sequence VPGAVGQGRKHLGRV (SEQ ID NO:1758) corresponding to amino acids 224-238 of T39971_P12 (SEQ ID NO:1288), wherein said first and second amino acid sequences are contiguous and in a sequential order.

2. An isolated polypeptide encoding for a tail of T39971_P12 (SEQ ID NO:1288), comprising a polypeptide being at least 70%, optionally at least about 80%, preferably at least about 85%, more preferably at least about 90% and most preferably at least about 95% homologous to the sequence VPGAVGQGRKHLGRV (SEQ ID NO:1758) in T39971_P12 (SEQ ID NO:1288).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T39971_P12 (SEQ ID NO:1288) also has the following non-silent SNPs (Single Nucleotide Polymorphisms) as listed in Table 52, (given according to their position(s) on the amino acid sequence, with the alternative amino acid(s) listed; the last column indicates whether the SNP is known or not; the presence of known SNPs in variant protein T39971_P12 (SEQ ID NO:1288) sequence provides support for the deduced sequence of this variant protein according to the present invention).

TABLE 52

Amino acid mutations

| SNP position(s) on amino acid sequence | Alternative amino acid(s) | Previously known SNP? |
|---|---|---|
| 122 | A -> S | Yes |
| 145 | G -> | No |
| 180 | C -> | No |
| 180 | C -> W | No |
| 192 | Y -> | No |
| 209 | A -> | No |
| 211 | T -> | No |

Variant protein T39971_P12 (SEQ ID NO:1288) is encoded by the following transcript(s): T39971_T16 (SEQ ID NO:7), for which the sequence(s) is/are given at the end of the application. The coding portion of transcript T39971_T16 (SEQ ID NO:7) is shown in bold; this coding portion starts at position 756 and ends at position 1469. The transcript also has the following SNPs as listed in Table 53 (given according to their position on the nucleotide sequence, with the alternative nucleic acid listed; the last column indicates whether the SNP is known or not; the presence of known SNPs in variant protein T39971_P12 (SEQ ID NO:1288) sequence provides support for the deduced sequence of this variant protein according to the present invention).

TABLE 53

Nucleic acid SNPs

| SNP position on nucleotide sequence | Alternative nucleic acid | Previously known SNP? |
|---|---|---|
| 417 | G -> C | Yes |
| 459 | T -> C | Yes |
| 1387 | C -> | No |
| 1406 | -> A | No |
| 1406 | -> G | No |
| 529 | G -> T | Yes |
| 1119 | G -> T | Yes |
| 1188 | G -> | No |
| 1295 | C -> | No |
| 1295 | C -> G | No |
| 1324 | -> T | No |
| 1331 | C -> | No |
| 1381 | C -> | No |

As noted above, cluster T39971 features 28 segment(s), which were listed in Table 41 above and for which the sequence(s) are given at the end of the application. These segment(s) are portions of nucleic acid sequence(s) which are described herein separately because they are of particular interest. A description of each segment according to the present invention is now provided.

Segment cluster T39971_node_0 (SEQ ID NO:1039) according to the present invention is supported by 76 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 54 below describes the starting and ending position of this segment on each transcript.

TABLE 54

Segment location on transcripts

| Transcript name | Segment starting position | Segment ending position |
|---|---|---|
| T39971_T10 (SEQ ID NO:5) | 1 | 810 |
| T39971_T12 (SEQ ID NO:6) | 1 | 810 |
| T39971_T16 (SEQ ID NO:7) | 1 | 810 |
| T39971_T5 (SEQ ID NO:8) | 1 | 810 |

Segment cluster T39971_node_18 (SEQ ID NO:1040) according to the present invention is supported by 1 libraries. The number of libraries was determined as previously described. This segment can be found in the following transcript(s): T39971_T16 (SEQ ID NO:7). Table 55 below describes the starting and ending position of this segment on each transcript.

TABLE 55

Segment location on transcripts

| Transcript name | Segment starting position | Segment ending position |
|---|---|---|
| T39971_T16 (SEQ ID NO:7) | 1425 | 1592 |

Segment cluster T39971_node_21 (SEQ ID NO:1041) according to the present invention is supported by 99 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 56 below describes the starting and ending position of this segment on each transcript.

TABLE 56

Segment location on transcripts

| Transcript name | Segment starting position | Segment ending position |
|---|---|---|
| T39971_T10 (SEQ ID NO:5) | 1425 | 1581 |
| T39971_T12 (SEQ ID NO:6) | 1425 | 1581 |
| T39971_T5 (SEQ ID NO:8) | 1425 | 1581 |

Segment cluster T39971_node_22 (SEQ ID NO:1042) according to the present invention is supported by 7 libraries. The number of libraries was determined as previously described. This segment can be found in the following transcript(s): T39971_T5 (SEQ ID NO:8). Table 57 below describes the starting and ending position of this segment on each transcript.

TABLE 57

Segment location on transcripts

| Transcript name | Segment starting position | Segment ending position |
|---|---|---|
| T39971_T5 (SEQ ID NO:8) | 1582 | 1779 |

Segment cluster T39971_node_23 (SEQ ID NO:1043) according to the present invention is supported by 101 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 58 below describes the starting and ending position of this segment on each transcript.

TABLE 58

Segment location on transcripts

| Transcript name | Segment starting position | Segment ending position |
|---|---|---|
| T39971_T10 (SEQ ID NO:5) | 1582 | 1734 |
| T39971_T12 (SEQ ID NO:6) | 1582 | 1734 |
| T39971_T5 (SEQ ID NO:8) | 1780 | 1932 |

Segment cluster T39971_node_31 (SEQ ID NO:1044) according to the present invention is supported by 94 libraries. The number of libraries was determined as previously described. This segment can be found in the following transcript(s): T39971_T10 (SEQ ID NO:5) and T39971_T5 (SEQ ID NO:8). Table 59 below describes the starting and ending position of this segment on each transcript.

TABLE 59

Segment location on transcripts

| Transcript name | Segment starting position | Segment ending position |
|---|---|---|
| T39971_T10 (SEQ ID NO:5) | 1847 | 1986 |
| T39971_T5 (SEQ ID NO:8) | 2138 | 2277 |

Segment cluster T39971_node_33 (SEQ ID NO:1045) according to the present invention is supported by 77 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 60 below describes the starting and ending position of this segment on each transcript.

TABLE 60

Segment location on transcripts

| Transcript name | Segment starting position | Segment ending position |
|---|---|---|
| T39971_T10 (SEQ ID NO:5) | 1987 | 2113 |
| T39971_T12 (SEQ ID NO:6) | 1735 | 1861 |
| T39971_T5 (SEQ ID NO:8) | 2278 | 2404 |

Segment cluster T39971_node_7 (SEQ ID NO:1046) according to the present invention is supported by 87 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 61 below describes the starting and ending position of this segment on each transcript.

TABLE 61

Segment location on transcripts

| Transcript name | Segment starting position | Segment ending position |
|---|---|---|
| T39971_T10 (SEQ ID NO:5) | 940 | 1162 |
| T39971_T12 (SEQ ID NO:6) | 940 | 1162 |
| T39971_T16 (SEQ ID NO:7) | 940 | 1162 |
| T39971_T5 (SEQ ID NO:8) | 940 | 1162 |

According to an optional embodiment of the present invention, short segments related to the above cluster are also provided. These segments are up to about 120 bp in length, and so are included in a separate description.

Segment cluster T39971_node_1 (SEQ ID NO:1047) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 62 below describes the starting and ending position of this segment on each transcript.

TABLE 62

Segment location on transcripts

| Transcript name | Segment starting position | Segment ending position |
|---|---|---|
| T39971_T10 (SEQ ID NO:5) | 811 | 819 |
| T39971_T12 (SEQ ID NO:6) | 811 | 819 |
| T39971_T16 (SEQ ID NO:7) | 811 | 819 |
| T39971_T5 (SEQ ID NO:8) | 811 | 819 |

Segment cluster T39971_node_10 (SEQ ID NO:1048) according to the present invention is supported by 77 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 63 below describes the starting and ending position of this segment on each transcript.

TABLE 63

Segment location on transcripts

| Transcript name | Segment starting position | Segment ending position |
|---|---|---|
| T39971_T10 (SEQ ID NO:5) | 1189 | 1232 |
| T39971_T12 (SEQ ID NO:6) | 1189 | 1232 |
| T39971_T16 (SEQ ID NO:7) | 1189 | 1232 |
| T39971_T5 (SEQ ID NO:8) | 1189 | 1232 |

Segment cluster T39971_node_11 (SEQ ID NO:1049) according to the present invention is supported by 79 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 64 below describes the starting and ending position of this segment on each transcript.

TABLE 64

Segment location on transcripts

| Transcript name | Segment starting position | Segment ending position |
|---|---|---|
| T39971_T10 (SEQ ID NO:5) | 1233 | 1270 |
| T39971_T12 (SEQ ID NO:6) | 1233 | 1270 |
| T39971_T16 (SEQ ID NO:7) | 1233 | 1270 |
| T39971_T5 (SEQ ID NO:8) | 1233 | 1270 |

Segment cluster T39971_node_12 (SEQ ID NO:1050) according to the present invention can be found in the following transcript(s): T39971_T10 (SEQ ID NO:5), T39971_T12 (SEQ ID NO:6), T39971T16 (SEQ ID NO:7) and T39971_T5 (SEQ ID NO:8). Table 65 below describes the starting and ending position of this segment on each transcript.

TABLE 65

Segment location on transcripts

| Transcript name | Segment starting position | Segment ending position |
|---|---|---|
| T39971_T10 (SEQ ID NO:5) | 1271 | 1284 |
| T39971_T12 (SEQ ID NO:6) | 1271 | 1284 |
| T39971_T16 (SEQ ID NO:7) | 1271 | 1284 |
| T39971_T5 (SEQ ID NO:8) | 1271 | 1284 |

Segment cluster T39971_node_15 (SEQ ID NO:1051) according to the present invention is supported by 79 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 66 below describes the starting and ending position of this segment on each transcript.

TABLE 66

Segment location on transcripts

| Transcript name | Segment starting position | Segment ending position |
|---|---|---|
| T39971_T10 (SEQ ID NO:5) | 1285 | 1316 |
| T39971_T12 (SEQ ID NO:6) | 1285 | 1316 |
| T39971_T16 (SEQ ID NO:7) | 1285 | 1316 |
| T39971_T5 (SEQ ID NO:8) | 1285 | 1316 |

Segment cluster T39971_node_16 (SEQ ID NO:1052) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 67 below describes the starting and ending position of this segment on each transcript.

TABLE 67

Segment location on transcripts

| Transcript name | Segment starting position | Segment ending position |
|---|---|---|
| T39971_T10 (SEQ ID NO:5) | 1317 | 1340 |
| T39971_T12 (SEQ ID NO:6) | 1317 | 1340 |
| T39971_T16 (SEQ ID NO:7) | 1317 | 1340 |
| T39971_T5 (SEQ ID NO:8) | 1317 | 1340 |

Segment cluster T39971_node__17 (SEQ ID NO:1053) according to the present invention is supported by 86 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 68 below describes the starting and ending position of this segment on each transcript.

TABLE 68

Segment location on transcripts

| Transcript name | Segment starting position | Segment ending position |
|---|---|---|
| T39971_T10 (SEQ ID NO:5) | 1341 | 1424 |
| T39971_T12 (SEQ ID NO:6) | 1341 | 1424 |
| T39971_T16 (SEQ ID NO:7) | 1341 | 1424 |
| T39971_T5 (SEQ ID NO:8) | 1341 | 1424 |

Segment cluster T39971_node__26 (SEQ ID NO:1054) according to the present invention is supported by 85 libraries. The number of libraries was determined as previously described. This segment can be found in the following transcript(s): T39971_T5 (SEQ ID NO:8). Table 69 below describes the starting and ending position of this segment on each transcript.

TABLE 69

Segment location on transcripts

| Transcript name | Segment starting position | Segment ending position |
|---|---|---|
| T39971_T5 (SEQ ID NO:8) | 1933 | 1974 |

Segment cluster T39971_node__27 (SEQ ID NO:1055) according to the present invention is supported by 90 libraries. The number of libraries was determined as previously described. This segment can be found in the following transcript(s): T39971_T5 (SEQ ID NO:8). Table 70 below describes the starting and ending position of this segment on each transcript.

TABLE 70

Segment location on transcripts

| Transcript name | Segment starting position | Segment ending position |
|---|---|---|
| T39971_T5 (SEQ ID NO:8) | 1975 | 2025 |

Segment cluster T39971_node__28 (SEQ ID NO:1056) according to the present invention can be found in the following transcript(s): T39971_T10 (SEQ ID NO:5) and T39971_T5 (SEQ ID NO:8). Table 71 below describes the starting and ending position of this segment on each transcript.

TABLE 71

Segment location on transcripts

| Transcript name | Segment starting position | Segment ending position |
|---|---|---|
| T39971_T10 (SEQ ID NO:5) | 1735 | 1743 |
| T39971_T5 (SEQ ID NO:8) | 2026 | 2034 |

Segment cluster T39971_node__29 (SEQ ID NO:1057) according to the present invention is supported by 99 libraries. The number of libraries was determined as previously described. This segment can be found in the following transcript(s): T39971_T10 (SEQ ID NO:5) and T39971_T5 (SEQ ID NO:8). Table 72 below describes the starting and ending position of this segment on each transcript.

TABLE 72

Segment location on transcripts

| Transcript name | Segment starting position | Segment ending position |
|---|---|---|
| T39971_T10 (SEQ ID NO:5) | 1744 | 1838 |
| T39971_T5 (SEQ ID NO:8) | 2035 | 2129 |

Segment cluster T39971_node__3 (SEQ ID NO:1058) according to the present invention is supported by 78 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 73 below describes the starting and ending position of this segment on each transcript.

TABLE 73

Segment location on transcripts

| Transcript name | Segment starting position | Segment ending position |
|---|---|---|
| T39971_T10 (SEQ ID NO:5) | 820 | 861 |
| T39971_T12 (SEQ ID NO:6) | 820 | 861 |
| T39971_T16 (SEQ ID NO:7) | 820 | 861 |
| T39971_T5 (SEQ ID NO:8) | 820 | 861 |

Segment cluster T39971_node__30 (SEQ ID NO:1059) according to the present invention can be found in the following transcript(s): T39971_T10 (SEQ ID NO:5) and T39971_T5 (SEQ ID NO:8). Table 74 below describes the starting and ending position of this segment on each transcript.

TABLE 74

Segment location on transcripts

| Transcript name | Segment starting position | Segment ending position |
|---|---|---|
| T39971_T10 (SEQ ID NO:5) | 1839 | 1846 |
| T39971_T5 (SEQ ID NO:8) | 2130 | 2137 |

Segment cluster T39971_node__34 (SEQ ID NO:1060) according to the present invention can be found in the following transcript(s): T39971_T10 (SEQ ID NO:5), T39971_T12 (SEQ ID NO:6) and T39971_T5 (SEQ ID NO:8). Table 75 below describes the starting and ending position of this segment on each transcript.

TABLE 75

Segment location on transcripts

| Transcript name | Segment starting position | Segment ending position |
|---|---|---|
| T39971_T10 (SEQ ID NO:5) | 2114 | 2120 |
| T39971_T12 (SEQ ID NO:6) | 1862 | 1868 |
| T39971_T5 (SEQ ID NO:8) | 2405 | 2411 |

Segment cluster T39971_node_35 (SEQ ID NO:1061) according to the present invention can be found in the following transcript(s): T39971_T10 (SEQ ID NO:5), T39971_T12 (SEQ ID NO:6) and T39971_T5 (SEQ ID NO:8). Table 76 below describes the starting and ending position of this segment on each transcript.

TABLE 76

Segment location on transcripts

| Transcript name | Segment starting position | Segment ending position |
|---|---|---|
| T39971_T10 (SEQ ID NO:5) | 2121 | 2137 |
| T39971_T12 (SEQ ID NO:6) | 1869 | 1885 |
| T39971_T5 (SEQ ID NO:8) | 2412 | 2428 |

Segment cluster T39971_node_36 (SEQ ID NO:1062) according to the present invention is supported by 51 libraries. The number of libraries was determined as previously described. This segment can be found in the following transcript(s): T39971_T10 (SEQ ID NO:5), T39971_T12 (SEQ ID NO:6) and T39971_T5 (SEQ ID NO:8). Table 77 below describes the starting and ending position of this segment on each transcript.

TABLE 77

Segment location on transcripts

| Transcript name | Segment starting position | Segment ending position |
|---|---|---|
| T39971_T10 (SEQ ID NO:5) | 2138 | 2199 |
| T39971_T12 (SEQ ID NO:6) | 1886 | 1947 |
| T39971_T5 (SEQ ID NO:8) | 2429 | 2490 |

Segment cluster T39971_node_4 (SEQ ID NO:1063) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 78 below describes the starting and ending position of this segment on each transcript.

TABLE 78

Segment location on transcripts

| Transcript name | Segment starting position | Segment ending position |
|---|---|---|
| T39971_T10 (SEQ ID NO:5) | 862 | 881 |
| T39971_T12 (SEQ ID NO:6) | 862 | 881 |
| T39971_T16 (SEQ ID NO:7) | 862 | 881 |
| T39971_T5 (SEQ ID NO:8) | 862 | 881 |

Segment cluster T39971_node_5 (SEQ ID NO:1064) according to the present invention is supported by 80 libraries. The number of libraries was determined as previously described. This segment can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 79 below describes the starting and ending position of this segment on each transcript.

TABLE 79

Segment location on transcripts

| Transcript name | Segment starting position | Segment ending position |
|---|---|---|
| T39971_T10 (SEQ ID NO:5) | 882 | 939 |
| T39971_T12 (SEQ ID NO:6) | 882 | 939 |
| T39971_T16 (SEQ ID NO:7) | 882 | 939 |
| T39971_T5 (SEQ ID NO:8) | 882 | 939 |

Segment cluster T39971_node_8 (SEQ ID NO:1065) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 80 below describes the starting and ending position of this segment on each transcript.

TABLE 80

Segment location on transcripts

| Transcript name | Segment starting position | Segment ending position |
|---|---|---|
| T39971_T10 (SEQ ID NO:5) | 1163 | 1168 |
| T39971_T12 (SEQ ID NO:6) | 1163 | 1168 |
| T39971_T16 (SEQ ID NO:7) | 1163 | 1168 |
| T39971_T5 (SEQ ID NO:8) | 1163 | 1168 |

Segment cluster T39971_node_9 (SEQ ID NO:1066) according to the present invention can be found in the following transcript(s): T39971_T10 (SEQ ID NO:5), T39971_T12 (SEQ ID NO:6), T39971_T16 (SEQ ID NO:7) and T39971_T5 (SEQ ID NO:8). Table 81 below describes the starting and ending position of this segment on each transcript.

TABLE 81

Segment location on transcripts

| Transcript name | Segment starting position | Segment ending position |
|---|---|---|
| T39971_T10 (SEQ ID NO:5) | 1169 | 1188 |
| T39971_T12 (SEQ ID NO:6) | 1169 | 1188 |
| T39971_T16 (SEQ ID NO:7) | 1169 | 1188 |
| T39971_T5 (SEQ ID NO:8) | 1169 | 1188 |

Variant protein alignment to the previously known protein:

Sequence name: /tmp/xkraCL2OcZ/43L7YcPH7x:VTNC_HUMAN (SEQ ID NO:1418)

Sequence documentation:

Alignment of: T39971_P6 (SEQ ID NO:1285) x VTNC_HUMAN (SEQ ID NO:1418) . . .

Alignment segment 1/1:

| | |
|---|---|
| Quality: 2774.00 | Escore: 0 |
| Matching length: 278 | Total length: 278 |
| Matching Percent Similarity: 99.64 | Matching Percent Identity: 99.64 |

Alignment segment 1/1:

| | |
|---|---|
| Total Percent Similarity: 99.64 Total Percent Identity: 99.64 Gaps: 0 | Quality: 4430.00  Escore: 0<br>Matching length: 447  Total length: 478<br>Matching Percent Similarity: 100.00  Matching Percent Identity: 100.00 |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGTQ                      278
    |||||||||||||||||||||||||| |
251 PDNVDAALALPAHSYSGRERVYFFKGKQ                      278
```

Sequence name: /tmp/X4DeeuSlB4/yMubSR5FPs:VTNC_HUMAN (SEQ ID NO:1418)

Sequence documentation:

Alignment of: T39971_P9 (SEQ ID NO:1286) x VTNC_HUMAN (SEQ ID NO:1418) . . .

Total Percent Similarity: 93.51  Total Percent Identity: 93.51
Gaps: 1

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    ||||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRT........................ 325
    ||||||||||||||||||||||||
301 VFEHFAMMQRDSWEDIFELLFWGRTSAGTRQPQFISRDWHGVPGQVDAAM 350

326 ......SGMAPRPSLAKKQRFRHRNRKGYRSQRGHSRGRNQNSRRPSRAT 369
          ||||||||||||||||||||||||||||||||||||||||||||
351 AGRIYISGMAPRPSLAKKQRFRHRNRKGYRSQRGHSRGRNQNSRRPSRAT 400
```

-continued

```
370 WLSLFSSEESNLGANNYDDYRMDWLVPATCEPIQSVFFFSGDKYYRVNLR 419
    ||||||||||||||||||||||||||||||||||||||||||||||||||
401 WLSLFSSEESNLGANNYDDYRMDWLVPATCEPIQSVFFFSGDKYYRVNLR 450

420 TRRVDTVDPPYPRSIAQYWLGCPAPGHL                      447
    ||||||||||||||||||||||||||||
451 TRRVDTVDPPYPRSIAQYWLGCPAPGHL                      478
```

Sequence name: /tmp/jvp1VtnxNy/wxNSeFVZZw:VT-NC_HUMAN (SEQ ID NO:1418)

Sequence documentation:

Alignment of: T39971_P11 (SEQ ID NO:1287) x VTNC_HUMAN (SEQ ID NO:1418)

Alignment segment 1/1:

| | |
|---|---|
| Quality: 3576.00 | Escore: 0 |
| Matching length: 363 | Total length: 478 |
| Matching Percent Similarity: 100.00 | Matching Percent Identity: 100.00 |
| Total Percent Similarity: 75.94 | Total Percent Identity: 75.94 |
| Gaps: 1 | |

Alignment:

```
  1 MAPLRPLLILALLAWVALADQESCKGRCTEGFNVDKKCQCDELCSYYQSC 50
    ||||||||||||||||||||||||||||||||||||||||||||||||||
  1 MAPLRPLLILALLAWVALADQESCKGRCTEGFNVDKKCQCDELCSYYQSC 50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    ||||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRTS........................ 326
    |||||||||||||||||||||||||||
301 VFEHFAMMQRDSWEDIFELLFWGRTSAGTRQPQFISRDWHGVPGQVDAAM 350

326 .................................................. 326

351 AGRIYISGMAPRPSLAKKQRFRHRNRKGYRSQRGHSRGRNQNSRRPSRAT 400

327 ...........................................DKYYRVNLR 335
                                               |||||||||
401 WLSLFSSEESNLGANNYDDYRMDWLVPATCEPIQSVFFFSGDKYYRVNLR 450

420 TRRVDTVDPPYPRSIAQYWLGCPAPGHL                      363
    ||||||||||||||||||||||||||||
451 TRRVDTVDPPYPRSIAQYWLGCPAPGHL                      478
```

Sequence name: /tmp/jvp1Vtnxsy/wxNSeFVZZw:Q9BSH7

Sequence documentation:

Alignment of: T39971_P11 (SEQ ID NO:1287) x Q9BSH7 . . .

Alignment segment 1/1:

| | |
|---|---|
| Quality: 3576.00 | Escore: 0 |
| Matching length: 363 | Total length: 478 |
| Matching Percent Similarity: 100.00 | Matching Percent Identity: 100.00 |
| Total Percent Similarity: 75.94 | Total Percent Identity: 75.94 |
| Gaps: 1 | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFKGSQYWRFEDGVLDPDYPRNISDGFDGI 250
    ||||||||||||||||||||||||||||||||||||||||||||||||||
201 GIEGPIDAAFTRINCQGKTYLFKGSQYWRFEDGVLDPDYPRNISDGFDGI 250

251 PDNVDAALALPAHSYSGRERVYFFKGKQYWEYQFQHQPSQEECEGSSLSA 300
    ||||||||||||||||||||||||||||||||||||||||||||||||||
251 PDNVDAALALPAHSYSGRERVYFFKGKQYWEYQFQHQPSQEECEGSSLSA 300

301 VFEHFAMMQRDSWEDIFELLFWGRTS........................ 326
    |||||||||||||||||||||||||||
301 VFEHFAMMQRDSWEDIFELLFWGRTSAGTRQPQFISRDWHGVPGQVDAAM 350

326 .................................................. 326

351 AGRIYISGMAPRPSLAKKQRFRHRNRKGYRSQRGHSRGRNQNSRRPSRAM 400

327 ..............................DKYYRVNLR 335
                                    |||||||||
401 WLSLFSSEESNLGANNYDDYRMDWLVPATCEPIQSVFFFSGDKYYRVNLR 450

420 TRRVDTVDPPYPRSIAQYWLGCPAPGHL                       363
    ||||||||||||||||||||||||||||
451 TRRVDTVDPPYPRSIAQYWLGCPAPGHL                       478
```

Sequence name: /tmp/fgebv7ir4i/48bTBMziJ0:VTNC_HUMAN (SEQ ID NO:1418)

Sequence documentation:

Alignment of: T39971_P12 (SEQ ID NO:1288) x VTNC_HUMAN (SEQ ID NO:1418)

Alignment segment 1/1:

| | |
|---|---|
| Quality: 2237.00 | Escore: 0 |
| Matching length: 223 | Total length: 223 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFK                             223
    |||||||||||||||||||||||
201 GIEGPIDAAFTRINCQGKTYLFK                             223
```

Sequence name: /tmp/fgebv7ir4i/48bTBMziJ0:Q9BSH7

Sequence documentation:

Alignment of: T39971_P12 (SEQ ID NO:1288) x Q9BSH7 . . .

Alignment segment 1/1:

| | |
|---|---|
| Quality: 2237.00 | Escore: 0 |
| Matching length: 223 | Total length: 223 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MAPLRPLLILALLAWVALADQESCKGRCTEGFNVDKKCQCDELCSYYQSC  50
    ||||||||||||||||||||||||||||||||||||||||||||||||||
  1 MAPLRPLLILALLAWVALADQESCKGRCTEGFNVDKKCQCDELCSYYQSC  50

51 CTDYTAECKPQVTRGDVFTMPEDEYTVYDDGEEKNNATVHEQVGGPSLTS 100
    ||||||||||||||||||||||||||||||||||||||||||||||||||
 51 CTDYTAECKPQVTRGDVFTMPEDEYTVYDDGEEKNNATVHEQVGGPSLTS 100

101 DLQAQSKGNPEQTPVLKPEEEAPAPEVGASKPEGIDSRPETLHPGRPQPP 150
    ||||||||||||||||||||||||||||||||||||||||||||||||||
101 DLQAQSKGNPEQTPVLKPEEEAPAPEVGASKPEGIDSRPETLHPGRPQPP 150

151 AEEELCSGKPFDAFTDLKNGSLFAFRGQYCYELDEKAVRPGYPKLIRDVW 200
    ||||||||||||||||||||||||||||||||||||||||||||||||||
151 AEEELCSGKPFDAFTDLKNGSLFAFRGQYCYELDEKAVRPGYPKLIRDVW 200

201 GIEGPIDAAFTRINCQGKTYLFK                             223
    |||||||||||||||||||||||
201 GIEGPIDAAFTRINCQGKTYLFK                             223
```

TABLE 82

Transcripts of interest

| Transcript Name | Sequence ID No. |
|---|---|
| Z21368_PEA_1_T10 | 9 |
| Z21368_PEA_1_T11 | 10 |
| Z21368_PEA_1_T23 | 11 |
| Z21368_PEA_1_T24 | 12 |
| Z21368_PEA_1_T5 | 13 |
| Z21368_PEA_1_T6 | 14 |
| Z21368_PEA 1_T9 | 15 |

Description for Cluster Z21368

Cluster Z21368 features 7 transcript(s) and 34 segment(s) of interest, the names for which are given in Tables 82 and 83, respectively, the sequences themselves are given at the end of the application. The selected protein variants are given in table 84.

TABLE 83

Segments of interest

| Segment Name | Sequence ID No. |
|---|---|
| Z21368_PEA_1_node_0 | 1067 |
| Z21368_PEA_1_node_15 | 1068 |

TABLE 83-continued

Segments of interest

| Segment Name | Sequence ID No. |
| --- | --- |
| Z21368_PEA_1_node_19 | 1069 |
| Z21368_PEA_1_node_2 | 1070 |
| Z21368_PEA_1_node_21 | 1071 |
| Z21368_PEA_1_node_33 | 1072 |
| Z21368_PEA_1_node_36 | 1073 |
| Z21368_PEA_1_node_37 | 1074 |
| Z21368_PEA_1_node_39 | 1075 |
| Z21368_PEA_1_node_4 | 1076 |
| Z21368_PEA_1_node_41 | 1077 |
| Z21368_PEA_1_node_43 | 1078 |
| Z21368_PEA_1_node_45 | 1079 |
| Z21368_PEA_1_node_53 | 1080 |
| Z21368_PEA_1_node_56 | 1081 |
| Z21368_PEA_1_node_58 | 1082 |
| Z21368_PEA_1_node_66 | 1083 |
| Z21368_PEA_1_node_67 | 1084 |
| Z21368_PEA_1_node_69 | 1085 |
| Z21368_PEA_1_node_11 | 1086 |
| Z21368_PEA_1_node_12 | 1087 |
| Z21368_PEA_1_node_16 | 1088 |
| Z21368_PEA_1_node_17 | 1089 |
| Z21368_PEA_1_node_23 | 1090 |
| Z21368_PEA_1_node_24 | 1091 |
| Z21368_PEA_1_node_30 | 1092 |
| Z21368_PEA_1_node_31 | 1093 |
| Z21368_PEA_1_node_38 | 1094 |
| Z21368_PEA_1_node_47 | 1095 |
| Z21368_PEA_1_node_49 | 1096 |
| Z21368_PEA_1_node_51 | 1097 |
| Z21368_PEA_1_node_61 | 1098 |
| Z21368_PEA_1_node_68 | 1099 |
| Z21368_PEA_1_node_7 | 1100 |

TABLE 84

Proteins of interest

| Protein Name | Sequence ID No. |
| --- | --- |
| Z21368_PEA_1_P2 | 1289 |
| Z21368_PEA_1_P5 | 1290 |
| Z21368_PEA_1_P15 | 1291 |
| Z21368_PEA_1_P16 | 1292 |
| Z21368_PEA_1_P22 | 1293 |
| Z21368_PEA_1_P23 | 1294 |

These sequences are variants of the known protein Extracellular sulfatase Sulf-1 precursor (SwissProt accession identifier SUL1_HUMAN; known also according to the synonyms EC 3.1.6.-; HSulf-1), SEQ ID NO:1419, referred to herein as the previously known protein.

Protein Extracellular sulfatase Sulf-1 precursor (SEQ ID NO:1419) is known or believed to have the following function(s): Exhibits arylsulfatase activity and highly specific endoglucosamine-6-sulfatase activity. It can remove sulfate from the C-6 position of glucosamine within specific subregions of intact heparin. Diminishes HSPG (heparan sulfate proteoglycans) sulfation, inhibits signaling by heparin-dependent growth factors, diminishes proliferation, and facilitates apoptosis in response to exogenous stimulation. The sequence for protein Extracellular sulfatase Sulf-1 precursor is given at the end of the application, as "Extracellular sulfatase Sulf-1 precursor amino acid sequence". Known polymorphisms for this sequence are as shown in Table 85.

TABLE 85

Amino acid mutations for Known Protein

| SNP position(s) on amino acid sequence | Comment |
| --- | --- |
| 87-88 | CC -> AA: LOSS OF ARYLSULFATASE ACTIVITY AND LOSS OF ABILITY TO MODULATE APOPTOSIS. |
| 49 | L -> P |
| 728 | K -> R |

Protein Extracellular sulfatase Sulf-1 precursor (SEQ ID NO:1419) localization is believed to be Endoplasmic reticulum and Golgi stack. Also localized on the cell surface (By similarity).

The following GO Annotation(s) apply to the previously known protein. The following annotation(s) were found: apoptosis; metabolism; heparan sulfate proteoglycan metabolism, which are annotation(s) related to Biological Process; arylsulfatase; hydrolase, which are annotation(s) related to Molecular Function; and extracellular space; endoplasmic reticulum; Golgi apparatus, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster Z21368 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 13 refer to weighted expression of ESTs in each category, as "parts per million" (ratio of the expression of ESTs for a particular cluster to the expression of all ESTs in that category, according to parts per million).

Figure 13:
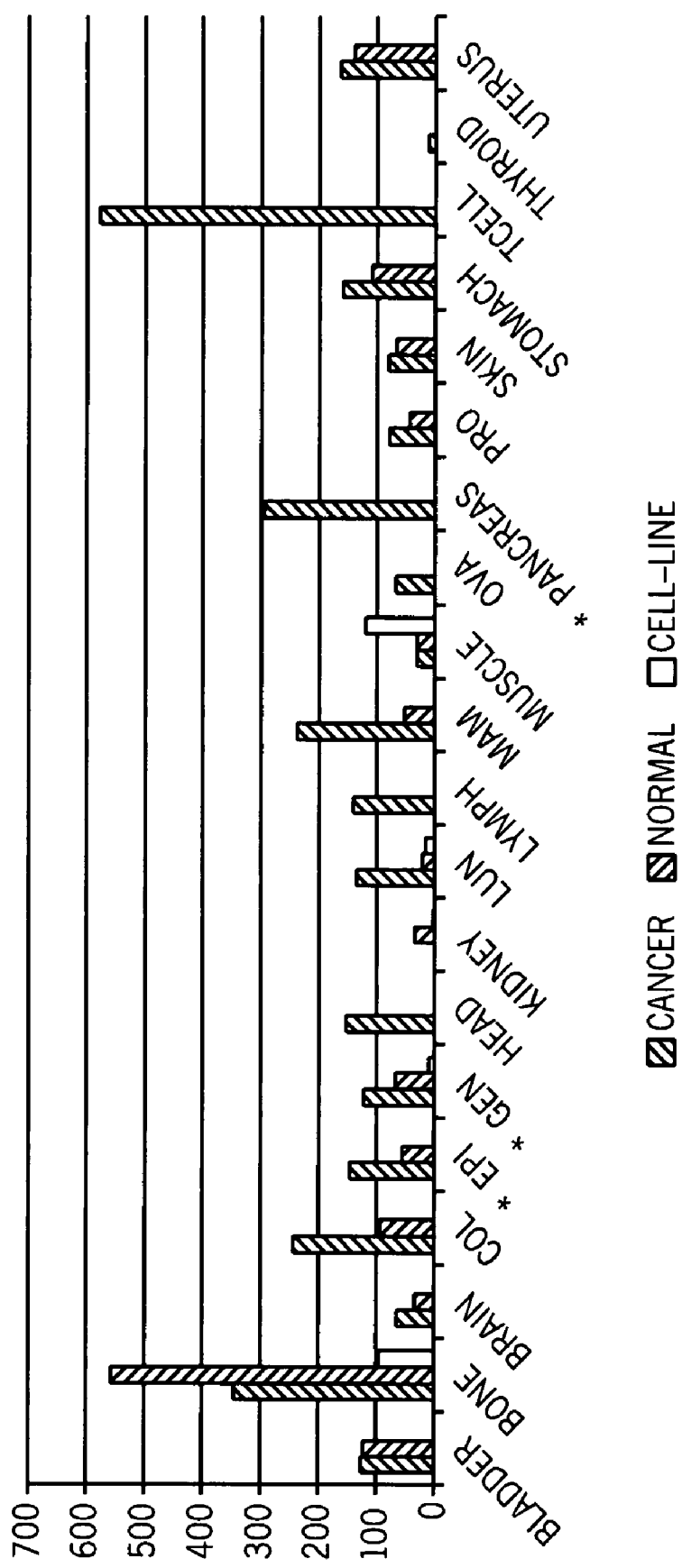
FIG. 13 is a histogram showing Cancer and cell-line vs. normal tissue expression for Cluster Z21368, demonstrating overexpression in epithelial malignant tumors, a mixture of malignant tumors from different tissues and pancreas carcinoma.

Overall, the following results were obtained as shown with regard to the histograms in FIG. 13 and Table 86. This cluster is overexpressed (at least at a minimum level) in the following pathological conditions: epithelial malignant tumors, a mixture of malignant tumors from different tissues and pancreas carcinoma.

TABLE 86

Normal tissue distribution

| Name of Tissue | Number |
| --- | --- |
| bladder | 123 |
| Bone | 557 |
| Brain | 34 |
| Colon | 94 |
| epithelial | 56 |
| general | 68 |
| head and neck | 0 |
| kidney | 35 |
| Lung | 22 |
| Lymph nodes | 0 |
| Breast | 52 |
| muscle | 31 |
| Ovary | 0 |
| pancreas | 0 |
| prostate | 44 |
| Skin | 67 |
| stomach | 109 |
| T cells | 0 |
| Thyroid | 0 |
| Uterus | 140 |

TABLE 87

P values and ratios for expression in cancerous tissue

| Name of Tissue | P1 | P2 | SP1 | R3 | SP2 | R4 |
|---|---|---|---|---|---|---|
| bladder | 5.4e-01 | 6.6e-01 | 6.4e-01 | 1.0 | 8.5e-01 | 0.7 |
| Bone | 4.5e-01 | 8.2e-01 | 9.1e-01 | 0.4 | 1 | 0.3 |
| Brain | 5.5e-01 | 7.3e-01 | 1.5e-01 | 1.5 | 5.0e-01 | 0.9 |
| Colon | 1.4e-01 | 2.8e-01 | 1.0e-01 | 2.0 | 3.0e-01 | 1.4 |
| epithelial | 1.1e-03 | 1.5e-01 | 1.2e-07 | 2.1 | 1.0e-01 | 1.1 |
| general | 1.4e-05 | 5.3e-02 | 1.9e-06 | 1.6 | 6.7e-01 | 0.8 |
| head and neck | 2.4e-02 | 7.1e-02 | 4.6e-01 | 2.5 | 7.5e-01 | 1.4 |
| kidney | 8.9e-01 | 9.0e-01 | 1 | 0.4 | 1 | 0.4 |
| Lung | 3.5e-01 | 4.1e-01 | 7.2e-03 | 2.6 | 1.0e-01 | 1.6 |
| Lymph nodes | 7.7e-02 | 3.1e-01 | 2.3e-02 | 8.5 | 1.9e-01 | 3.2 |
| Breast | 4.0e-01 | 6.1e-01 | 5.4e-02 | 2.3 | 3.0e-01 | 1.3 |
| muscle | 7.5e-02 | 3.5e-02 | 1 | 1.0 | 1.7e-01 | 1.7 |
| Ovary | 3.8e-01 | 4.2e-01 | 2.2e-01 | 2.9 | 3.4e-01 | 2.2 |
| pancreas | 2.2e-02 | 6.9e-02 | 1.4e-08 | 6.5 | 1.4e-06 | 4.6 |
| prostate | 8.3e-01 | 8.9e-01 | 3.1e-01 | 1.4 | 5.2e-01 | 1.1 |
| Skin | 6.1e-01 | 8.1e-01 | 6.0e-01 | 1.2 | 1 | 0.3 |
| stomach | 4.4e-02 | 5.0e-01 | 5.0e-01 | 0.8 | 9.7e-01 | 0.4 |
| T cells | 5.0e-01 | 6.7e-01 | 3.3e-01 | 3.1 | 7.2e-01 | 1.4 |
| Thyroid | 3.6e-01 | 3.6e-01 | 1 | 1.1 | 1 | 1.1 |
| Uterus | 3.5e-01 | 7.8e-01 | 4.6e-01 | 0.9 | 9.1e-01 | 0.5 |

As noted above, cluster Z21368 features 7 transcript(s), which were listed in Table 82 above. These transcript(s) encode for protein(s) which are variant(s) of protein Extracellular sulfatase Sulf-1 precursor (SEQ ID NO:1419). A description of each variant protein according to the present invention is now provided.

Variant protein Z21368_PEA_1_P2 (SEQ ID NO:1289) according to the present invention has an amino acid sequence as given at the end of the application; it is encoded by transcript(s) Z21368_PEA_1_T5 (SEQ ID NO:13). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368_PEA_1_P2 (SEQ ID NO:1289) and SUL1_HUMAN (SEQ ID NO:1419):

1. An isolated chimeric polypeptide encoding for Z21368_PEA_1_P2 (SEQ ID NO:1289), comprising a first amino acid sequence being at least 90% homologous to MKYSCCALVLAVLGTELLGSLCSTVRSPRFRGRIQ-QERKNIRPNIILVLTDDQDVELGSLQVMNKTRKI-MEHGGAT FINAFVTTPMCCPSRSSMLTGKYVH-NHNVYTNNENCSSPSWQAMHEPRTFAVYLNNTGYR-TAFFGKYLNEYNGS YIPPGWREWLGLIKNSRFYNY-TVCRNGIKEKHGFDYAKDYFTDLITNESINYFKMS-KRMYPHRPVMMVISHAAPH GPEDSAPQFSKLYP-NASQHITPSYNYAPNMDKHWIMQYTGPMLPIHME-FTNILQRKRLQTLMSVDDSVERLYNML VETGELEN-TYIIYTADHGYHIGQFGLVKGKSMPYDFDIRVPFFIR-GPSVEPGSIVPQIVLNIDLAPTILDIAGLDTPPDV DGKSVLKLLDPEKPGNRFRTNKKAKIWRDTFLVE-RGKFLRKKEESSKNIQQSNHLPKYERVKELCQQ-ARYQTACE QPGQKWQCIEDTSGKLRIHKCKGPS-DLLTVRQSTRNLYARGFHDKDKECSCRESGYRASRS-QRKSQRQFLRNQGT PKYKPRFVHTRQTRSLS-VEFEGEIYDINLEEEEELQVLQPRNIAKRHDEGH-KGPRDLQASSGGNRGRMLADSSNAV GPPTTVRVTH-KCFILPNDSIHCERELYQSARAWKDHKAYIDKEIEA-LQDKIKNLREVRGHLKRRKPEECSCSKQSY YNKEKGVKKQEKLKSHLHPFKEAAQEVDSKLQLFK-ENNRRRKKERKEKRRQRKGEECSLPGLTCFTHD-NNHWQT APFWN corresponding to amino acids 1-761 of SUL1_HUMAN (SEQ ID NO:1419), which also corresponds to amino acids 1-761 of Z21368_PEA_1_P2 (SEQ ID NO:1289), and a second amino acid sequence being at least 70%, optionally at least 80%, preferably at least 85%, more preferably at least 90% and most preferably at least 95% homologous to a polypeptide having the sequence PHKYSAHGRTRHFESATRTTNGAQKLSRI (SEQ ID NO:1759) corresponding to amino acids 762-790 of Z21368_PEA_1_P2 (SEQ ID NO:1289), wherein said first and second amino acid sequences are contiguous and in a sequential order.

2. An isolated polypeptide encoding for a tail of Z21368_PEA_1_P2 (SEQ ID NO:1289), comprising a polypeptide being at least 70%, optionally at least about 80%, preferably at least about 85%, more preferably at least about 90% and most preferably at least about 95% homologous to the sequence PHKYSAHGRTRHFESATRTTNGAQKLSRI (SEQ ID NO:1759) in Z21368_PEA_1_P2 (SEQ ID NO:1289).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P2 (SEQ ID NO:1289) is encoded by the following transcript(s): Z21368_PEA_1_T5 (SEQ ID NO:13), for which the sequence(s) is/are given at the end of the application. The coding portion of transcript Z21368_PEA_1_T5 (SEQ ID NO:13) is shown in bold; this coding portion starts at position 529 and ends at position 2898.

Variant protein Z21368_PEA_1_P5 (SEQ ID NO:1290) according to the present invention has an amino acid sequence as given at the end of the application; it is encoded by transcript(s) Z21368_PEA_1_T9 (SEQ ID NO:15). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368_PEA_1_P5 (SEQ ID NO:1290) and Q7Z2W2 (SEQ ID NO:1697):

1. An isolated chimeric polypeptide encoding for Z21368_PEA_1_P5 (SEQ ID NO:1290), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of Q7Z2W2 (SEQ ID NO:1697), which also corresponds to amino acids 1-57 of Z21368_PEA_1_P5 (SEQ ID NO:1290), second bridging amino acid sequence comprising A, and a third amino acid sequence being at least 90% homologous to FFGKYLNEY-NGSYIPPGWREWLGLIKNSRFYNYTVCRNGIK-EKHGFDYAKDYFTDLITNESINYFKMSKRMYPHRP VMMVISHAAPHGPEDSAPQFSKLYPNASQHITPS-YNYAPNMDKHWIMQYTGPMLPIHMEFTNILQRK-RLQTLMSV DDSVERLYNMLVETGELENTYIIYTADH-GYHIGQFGLVKGKSMPYDFDIRVPFFIRGPSVEPG- SIVPQIVLNIDLAPTI LDIAGLDTPPDVDGKSVLKLLD-PEKPGNRFRTNKKAKIWRDTFLVERGKFLRKKE-ESSKNIQQSNHLPKYERVKEL CQQARYQTA-CEQPGQKWQCIEDTSGKLRIHKCKGPSDLLTVRQS-TRNLYARGFHDKDKECSCRESGYRASRSQRK SQRQ-FLRNQGTPKYKPRFVHTRQTRSLSVEFEGEIYDINL-EEEEELQVLQPRNIAKRHDEGHKGPRDLQASSGGNR GRMLADSSNAVGPPTTVRVTHKCFILPNDSIHCERE-LYQSARAWKDHKAYIDKEIEALQDKIKNLREVRGH-LKRR KPEECSCSKQSYYNKEKGVKKQEKLK-SHLHPFKEAAQEVDSKLQLFKENNRRRKKERKEK-RRQRKGEECSLPGLT CFTHDNNHWQTAPFWNLGSF-CACTSSNNNTYWCLRTVNETHNFLFCEFATGFLE-YFDMNTDPYQLTNTVHTVER GILNQLHVQLMELR-SCQGYKQCNPRPKNLDVGNKDGGSYDLHRGQL-WDGWEG corresponding to amino acids 139-871 of Q7Z2W2 (SEQ ID NO:1697), which also corresponds to amino acids 59-791 of Z21368_PEA_1_P5 (SEQ ID NO:1290), wherein said first, second and third amino acid sequences are contiguous and in a sequential order.

2. An isolated polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least three amino acids comprise LAF, the sequence having a structure as follows (numbering according to Z21368_PEA_1_P5 (SEQ ID NO:1290)): a sequence starting from any of amino acid numbers 57-x to 57; and ending at any of amino acid numbers 59+((n−2)−x), in which x varies from 0 to n−2.

Comparison report between Z21368 PEA_1_P5 (SEQ ID NO:1290) and AAH12997 (SEQ ID NO:1698):

1. An isolated chimeric polypeptide encoding for Z21368_PEA_1_P5 (SEQ ID NO:1290), comprising a first amino acid sequence being at least 70%, optionally at least 80%, preferably at least 85%, more preferably at least 90% and most preferably at least 95% homologous to a polypeptide having the sequence MKYSCCALVLAVLG-TELLGSLCSTVRSPRFRGRIQQERKNIR-PNIILVLTDDQDVELAFFGKYLNEYNGSYIPPGWR EWLGLIKNSRFYNYTVCRNGIKEKHG-FDYAKDYFTDLITNESINYFKM-SKRMYPHRPVMMVISHAAPHGPEDSAP QFSKLYP-NASQHITPSYNYAPNMDKHWIMQYTGPMLPIHMEF-TNILQRKRLQTLMSVDDSVERLYNMLVETGELE NTYIIYTADHGYHIGQFGLVKGKSMPYD-FDIRVPFFIRGPSVEPGSIVPQIVLNID-LAPTILDIAGLDTPPDVDGKSVL KLLDPEKPGNRFRT-NKKAKIWRDTFLVERGKFLRKKEESSKNIQQSNHLP-KYERVKELCQQARYQTACEQPGQK WQCIEDTSGKL-RIHKCKGPSDLLTVRQSTRNLYARGFHD-KDKECSCRESGYRASRSQRKSQRQFLRNQGTPKYKP RFVHTRQTRSLSVEFEGEIYDIN-LEEEEELQVLQPRNIAKRHDEGHKG-PRDLQASSGGNRGRMLADSSNAVGPPTT VRVTHKC-FILPNDSIHCERELYQSARAWKDHKAYIDKEIEALQD-KIKNLREVRGHLKRRKPEECSCSKQSYYNKEK GVKKQEKLKSHLHPFKEAAQEVD-SKLQLFKENNRRRKKERKEKRRQRK-GEECSLPGLTCFTHDNNHWQTAPFWN LGSF-CACTSSNNNTYWCLRTVNETHNFLFCEFATGFLEYF-DMNTDPYQLTNTVHTVERGILNQLHVQLME (SEQ ID NO: 1760) corresponding to amino acids 1-751 of Z21368_PEA_1_P5 (SEQ ID NO:1290), and a second amino acid sequence being at least 90% homologous to LRSCQGYKQCNPRPKNLDVGNKDGGSY-DLHRGQLWDGWEG corresponding to amino acids 1-40 of AAH12997 (SEQ ID NO:1698), which also corresponds to amino acids 752-791 of Z21368_PEA_1_P5 (SEQ ID NO:1290), wherein said first and second amino acid sequences are contiguous and in a sequential order.

2. An isolated polypeptide encoding for a head of Z21368_PEA_1_P5 (SEQ ID NO:1290), comprising a polypeptide being at least 70%, optionally at least about 80%, preferably at least about 85%, more preferably at least about 90% and most preferably at least about 95% homologous to the sequence MKYSCCALVLAVLGTELLGSLCSTVR-SPRFRGRIQQERKNIRPNIILVLTDDQD-VELAFFGKYLNEYNGSYIPPGWR EWLGLIKNSR-FYNYTVCRNGIKEKHGFDYAKDYFTDLITNESINYFK-MSKRMYPHRPVMMVISHAAPHGPEDSAP QFSKLYP-NASQHITPSYNYAPNMDKHWIMQYTGPM-LPIHMEFTNILQRKRLQTLMSVDDSVER-LYNMLVETGELE NTYIIYTADHGYHIGQFGLVKGKSMPYD-FDIRVPFFIRGPSVEPGSIVPQIVLNID-LAPTILDIAGLDTPPDVDGKSVL KLLDPEKPGNRFRT-NKKAKIWRDTFLVERGKFLRKKEESSKNIQQSNHLP-KYERVKELCQQARYQTACEQPGQK WQCIEDTSGKL-RIHKCKGPSDLLTVRQSTRNLYARGFHD-KDKECSCRESGYRASRSQRKSQRQFLRNQGTPKYKP RFVHTRQTRSLSVEFEGEIYDIN-LEEEEELQVLQPRNIAKRHDEGHKG-PRDLQASSGGNRGRMLADSSNAVGPPTT VRVTHKC-FILPNDSIHCERELYQSARAWKDHKAYIDKEIEALQD-KIKNLREVRGHLKRRKPEECSCSKQSYYNKEK GVKKQEKLKSHLHPFKEAAQEVD-SKLQLFKENNRRRKKERKEKRRQRK-GEECSLPGLTCFTHDNNHWQTAPFWN LGSF-CACTSSNNNTYWCLRTVNETHNFLFCEFATGFLEYF-DMNTDPYQLTNTVHTVERGILNQLHVQLME (SEQ ID NO:1760) of Z21368_PEA_1_P5 (SEQ ID NO:1290).

Comparison report between Z21368_PEA_1_P5 (SEQ ID NO:1290) and SUL1_HUMAN (SEQ ID NO:1419):

1. An isolated chimeric polypeptide encoding for Z21368_PEA_1_P5 (SEQ ID NO:1290), comprising a first amino acid sequence being at least 90% homologous to MKYSCCALVLAVLGTELLGSLCSTVR-SPRFRGRIQQERKNIRPNIILVLTDDQDVEL corresponding to amino acids 1-57 of SUL1_HUMAN (SEQ ID NO:1419), which also corresponds to amino acids 1-57 of Z21368_PEA_1_P5 (SEQ ID NO:1290), and a second amino acid sequence being at least 90% homologous to AFF-GKYLNEYNGSYIPPGWREWLGLIKNSR-FYNYTVCRNGIKEKHGFDYAKDYFTDL-ITNESINYFKMSKRMYPH RPVMMVISHAAPHGPEDSAPQFSKLYP-NASQHITPSYNYAPNMDKHWIMQYTGPM-LPIHMEFTNILQRKRLQTLM SVDDSVERLYNMLVET-GELENTYIIYTADHGYHIGQFGLVKGKSMPYDFDIRV-PFFIRGPSVEPGSIVPQIVLNIDLA PTILDIAGLDTPPD-VDGKSVLKLLDPEKPGNRFRTNKKAKI-WRDTFLVERGKFLRKKEESSKNIQQSNHLPKYERV KELCQQARYQTACEQPGQKWQCIEDTS-GKLRIHKCKGPSDLLTVRQSTRNLYARG-FHDKDKECSCRESGYRASRS QRKSQRQFLRNQGTP-KYKPRFVHTRQTRSLSVEFEGEIYDINLEEEEELQVL-QPRNIAKRHDEGHKGPRDLQASSG GNRGRMLADSS-NAVGPPTTVRVTHKCFILPNDSIHCERE-LYQSARAWKDHKAYIDKEIEALQDKIKNLREVRGHL KRRKPEECSCSKQSYYNKEKGVKkQEK- LKSHLHPFKEAAQEVDSKLQLFKENNR-
RRKKERKEKRRQRKGEECSL PGLTCFTHDN-
NHWQTAPFWNLGSFCACTSSNNNTYWCLRTVNETH-
NFLFCEFATGFLEYFDMNTDPYQLTNTVH
TVERGILNQLHVQLMELRSCQGYKQCN-
PRPKNLDVGNKDGGSYDLHRGQLWDGWEG corresponding to amino acids 138-871 of SUL1_HUMAN (SEQ ID NO:1419), which also corresponds to amino acids 58-791 of Z21368_PEA_1_P5 (SEQ ID NO:1290), wherein said first and second amino acid sequences are contiguous and in a sequential order.

2. An isolated chimeric polypeptide encoding for an edge portion of Z21368_PEA_1_P5 (SEQ ID NO:1290), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise LA, having a structure as follows: a sequence starting from any of amino acid numbers 57-x to 57; and ending at any of amino acid numbers 58+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P5 (SEQ ID NO:1290) is encoded by the following transcript(s): Z21368_PEA_1_T9 (SEQ ID NO:15), for which the sequence(s) is/are given at the end of the application. The coding portion of transcript Z21368_PEA_1_T9 (SEQ ID NO:15) is shown in bold; this coding portion starts at position 556 and ends at position 2928.

Variant protein Z21368_PEA_1_P15 (SEQ ID NO:1291) according to the present invention has an amino acid sequence as given at the end of the application; it is encoded by transcripts) Z21368_PEA_1_T23 (SEQ ID NO:11). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368 PEA_1_P15 (SEQ ID NO:1291) and SUL1_HUMAN (SEQ ID NO:1419):

1. An isolated chimeric polypeptide encoding for Z21368_PEA_1_P15 (SEQ ID NO:1291), comprising a first amino acid sequence being at least 90% homologous to MKYSCCALVLAVLGTELLGSLCSTVR-
SPRFRGRIQQERKNIRPNIILVLTDDQD-
VELGSLQVMNKTRKIMEHGGAT FINAFVTTPMC-
CPSRSSMLTGKYVHNHNVYTNNENCSSPSWQAMHE-
PRTFAVYLNNTGYRTAFFGKYLNEYNGS YIPPG-
WREWLGLIKNSRFYNYTVCRNGIKEKHG-
FDYAKDYFTDLITNESINYFKM-
SKRMYPHRPVMMVISHAAPH
GPEDSAPQFSKLYPNASQHITPSYNYAP-
NMDKHWIMQYTGPMLPIHMEFT-
NILQRKRLQTLMSVDDSVERLYNML VETGELENTYI-
IYTADHGYHIGQFGLVKGKSMPYDFDIRVPFFIRGPS-
VEPGSIVPQIVLNIDLAPTILDIAGLDTPPDV DGKSV-
LKLLDPEKPGNRFRTNKKAKIWRDTFLVERG corresponding to amino acids 1-416 of SUL1_HUMAN (SEQ ID NO:1419), which also corresponds to amino acids 1-416 of Z21368_PEA_1_P15 (SEQ ID NO:1291).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P15 (SEQ ID NO:1291) is encoded by the following transcript(s): Z21368_PEA_1_T23 (SEQ ID NO:11), for which the sequence(s) is/are given at the end of the application. The coding portion of transcript Z21368_PEA_1_T23 (SEQ ID NO:11) is shown in bold; this coding portion starts at position 691 and ends at position 1938.

Variant protein Z21368_PEA_1_P16 (SEQ ID NO:1292) according to the present invention has an amino acid sequence as given at the end of the application; it is encoded by transcript(s) Z21368_PEA_1_T24 (SEQ ID NO:12). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368 PEA_1_P16 (SEQ ID NO:1292) and SUL1_HUMAN (SEQ ID NO:1419):

1. An isolated chimeric polypeptide encoding for Z21368_PEA_1_P16 (SEQ ID NO:1292), comprising a first amino acid sequence being at least 90% homologous to MKYSCCALVLAVLGTELLGSLCSTVRSPRFRG-
RIQQERKNIRPNIILVLTDDQDVELGSLQVMNKT-
RKIMEHGGAT FINAFVTTPMCCPSRSSMLTGKYVH-
NHNVYTNNENCSSPSWQAMHEPRTFAVYLNN-
TGYRTAFFGKYLNEYNGS YIPPGWREWLGLIKNSR-
FYNYTVCRNGIKEKHGFDYAKDYFTDL-
ITNESINYFKMSKRMYPHRPVMMVISHAAPH GPED-
SAPQFSKLYPNASQHITPSYNYAPNMDKHWIMQYTG-
PMLPIHMEFTNILQRKRLQTLMSVDDSVERLYNML
VETGELENTYIIYTADHGYHIGQF-
GLVKGKSMPYDFDIRVPFFIRGPSVEPG-
SIVPQIVLNIDLAPTILDIAGLDTPPDV DGKSVLKLLD-
PEKPGNR corresponding to amino acids 1-397 of SUL1_HUMAN (SEQ ID NO:1419), which also corresponds to amino acids 1-397 of Z21368_PEA_1_P16 (SEQ ID NO:1292), and a second amino acid sequence being at least 70%, optionally at least 80%, preferably at least 85%, more preferably at least 90% and most preferably at least 95% homologous to a polypeptide having the sequence CVIVPPLSQPQIH (SEQ ID NO:1761) corresponding to amino acids 398-410 of Z21368_PEA_1_P16 (SEQ ID NO:1292), wherein said first and second amino acid sequences are contiguous and in a sequential order.

2. An isolated polypeptide encoding for a tail of Z21368_PEA_1_P16 (SEQ ID NO:1292), comprising a polypeptide being at least 70%, optionally at least about 80%, preferably at least about 85%, more preferably at least about 90% and most preferably at least about 95% homologous to the sequence CVIVPPLSQPQIH (SEQ ID NO: 1761) in Z21368_PEA_1_P16 (SEQ ID NO:1292).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P16 (SEQ ID NO:1292) is encoded by the following transcript(s): Z21368 PEA_1_T24 (SEQ ID NO:12), for which the sequence(s) is/are given at the end of the application. The coding portion of transcript Z21368_PEA_1_T24 (SEQ ID NO:12) is shown in bold; this coding portion starts at position 691 and ends at position 1920.

Variant protein Z21368_PEA_1_P22 (SEQ ID NO:1293) according to the present invention has an amino acid sequence as given at the end of the application; it is encoded by transcript(s) Z21368_PEA_1_T10 (SEQ ID NO:9). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368_PEA_1_P22 (SEQ ID NO:1293) and SUL1_HUMAN (SEQ ID NO:1419):

1. An isolated chimeric polypeptide encoding for Z21368_PEA_1_P22 (SEQ ID NO:1293), comprising a first amino acid sequence being at least 90% homologous to MKYSCCALVLAVLGTELLGSLCSTVR-SPRFRGRIQQERKNIRPNIILVLTDDQD-VELGSLQVMNKTRKIMEHGGAT FINAFVTTPMC-CPSRSSMLTGKYVHNHNVYTNNENCSSPSWQAMHE-PRTFAVYLNNTGYRTAFFGKYLNEYNGS YIPPG-WREWLGLIKNSRFYNYTVCRNGIKEKHGFDYAK corresponding to amino acids 1-188 of SUL1_HUMAN (SEQ ID NO:1419), which also corresponds to amino acids 1-188 of Z21368_PEA_1_P22 (SEQ ID NO:1293), and a second amino acid sequence being at least 70%, optionally at least 80%, preferably at least 85%, more preferably at least 90% and most preferably at least 95% homologous to a polypeptide having the sequence ARYDGDQPRCAPRPRGLSPTVF (SEQ ID NO:1762) corresponding to amino acids 189-210 of Z21368_PEA_1_P22 (SEQ ID NO:1293), wherein said first and second amino acid sequences are contiguous and in a sequential order.

2. An isolated polypeptide encoding for a tail of Z21368_PEA_1_P22 (SEQ ID NO:1293), comprising a polypeptide being at least 70%, optionally at least about 80%, preferably at least about 85%, more preferably at least about 90% and most preferably at least about 95% homologous to the sequence ARYDGDQPRCAPRPRGLSPTVF (SEQ ID NO:1762) in Z21368_PEA_1_P22 (SEQ ID NO:1293).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P22 (SEQ ID NO:1293) is encoded by the following transcript(s): Z21368_PEA_1_T10 (SEQ ID NO:9), for which the sequence(s) is/are given at the end of the application. The coding portion of transcript Z21368_PEA_1_T10 (SEQ ID NO:9) is shown in bold; this coding portion starts at position 691 and ends at position 1320.

Variant protein Z21368_PEA_1_P23 (SEQ ID NO:1294) according to the present invention has an amino acid sequence as given at the end of the application; it is encoded by transcript(s) Z21368_PEA_1_T11 (SEQ ID NO:10). An alignment is given to the known protein (Extracellular sulfatase Sulf-1 precursor (SEQ ID NO:1419)) at the end of the application. One or more alignments to one or more previously published protein sequences are given at the end of the application. A brief description of the relationship of the variant protein according to the present invention to each such aligned protein is as follows:

Comparison report between Z21368_PEA_1_P23 (SEQ ID NO:1294) and Q7Z2W2 (SEQ ID NO:1697):

1. An isolated chimeric polypeptide encoding for Z21368_PEA_1_P23 (SEQ ID NO:1294), comprising a first amino acid sequence being at least 90% homologous to MKYSCCALVLAVLGTELLGSLCSTVR-SPRFRGRIQQERKNIRPNIILVLTDDQD-VELGSLQVMNKTRKIMEHGGAT FINAFVTTPMC-CPSRSSMLTGKYVHNHNVYTNNENCSSPSWQAMHE-PRTFAVYLNNTGYRT corresponding to amino acids 1-137 of Q7Z2W2 (SEQ ID NO:1697), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

2. An isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

Comparison report between Z21368_PEA_1_P23 (SEQ ID NO:1294) and SUL1_HUMAN (SEQ ID NO:1419):

1. An isolated chimeric polypeptide encoding for Z21368_PEA_1_P23 (SEQ ID NO:1294), comprising a first amino acid sequence being at least 90% homologous to MKYSCCALVLAVLGTELLGSLCSTVRSPRFRGRIQ-QERKNIRPNIILVLTDDQDVELGSLQVMNKTRKI-MEHGGAT FINAFVTTPMCCPSRSSMLTGKYVH-NHNVYTNNENCSSPSWQAMHEPRT-FAVYLNNTGYRT corresponding to amino acids 1-137 of SUL1_HUMAN (SEQ ID NO:1419), which also corresponds to amino acids 1-137 of Z21368_PEA_1_P23 (SEQ ID NO:1294), and a second amino acid sequence being at least 70%, optionally at least 80%, preferably at least 85%, more preferably at least 90% and most preferably at least 95% homologous to a polypeptide having the sequence GLL-HRLNH (SEQ ID NO:1763) corresponding to amino acids 138-145 of Z21368_PEA_1_P23 (SEQ ID NO:1294), wherein said first and second amino acid sequences are contiguous and in a sequential order.

2. An isolated polypeptide encoding for a tail of Z21368_PEA_1_P23 (SEQ ID NO:1294), comprising a polypeptide being at least 70%, optionally at least about 80%, preferably at least about 85%, more preferably at least about 90% and most preferably at least about 95% homologous to the sequence GLLHRLNH (SEQ ID NO:1763) in Z21368_PEA_1_P23 (SEQ ID NO:1294).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z21368_PEA_1_P23 (SEQ ID NO:1294) is encoded by the following transcript(s): Z21368_PEA_1_T11 (SEQ ID NO:10), for which the sequence(s) is/are given at the end of the application. The coding portion of transcript Z21368_PEA_1_T11 (SEQ ID NO:10) is shown in bold; this coding portion starts at position 691 and ends at position 1125.

As noted above, cluster Z21368 features 34 segment(s), which were listed in Table 83 above and for which the sequence(s) are given at the end of the application. These segment(s) are portions of nucleic acid sequence(s) which are described herein separately because they are of particular interest. A description of each segment according to the present invention is now provided.

Segment cluster Z21368_PEA_1_node_0 (SEQ ID NO:1067) according to the present invention is supported by 8 libraries. The number of libraries was determined as previously described. This segment can be found in the following transcript(s): Z21368_PEA_1_T9 (SEQ ID NO:15). Table 88 below describes the starting and ending position of this segment on each transcript.

TABLE 88

Segment location on transcripts

| Transcript name | Segment starting position | Segment ending position |
| --- | --- | --- |
| Z21368_PEA_1_T9 (SEQ ID NO:15) | 1 | 327 |

Segment cluster Z21368_PEA_1_node_15 (SEQ ID NO:1068) according to the present invention is supported by 26 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 89 below describes the starting and ending position of this segment on each transcript.

TABLE 89

Segment location on transcripts

| Transcript name | Segment starting position | Segment ending position |
| --- | --- | --- |
| Z21368_PEA_1_T10 (SEQ ID NO:9) | 631 | 807 |
| Z21368_PEA_1_T11 (SEQ ID NO:10) | 631 | 807 |
| Z21368_PEA_1_T23 (SEQ ID NO:11) | 631 | 807 |
| Z21368_PEA_1_T24 (SEQ ID NO:12) | 631 | 807 |
| Z21368_PEA_1_T5 (SEQ ID NO:13) | 469 | 645 |
| Z21368_PEA_1_T6 (SEQ ID NO:14) | 469 | 645 |
| Z21368_PEA_1_T9 (SEQ ID NO:15) | 496 | 672 |

Segment cluster Z21368_PEA_1_node_19 (SEQ ID NO:1069) according to the present invention is supported by 24 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13) and Z21368_PEA_1_T6 (SEQ ID NO:14). Table 90 below describes the starting and ending position of this segment on each transcript.

TABLE 90

Segment location on transcripts

| Transcript name | Segment starting position | Segment ending position |
| --- | --- | --- |
| Z21368_PEA_1_T10 (SEQ ID NO:9) | 863 | 1102 |
| Z21368_PEA_1_T11 (SEQ ID NO:10) | 863 | 1102 |
| Z21368_PEA_1_T23 (SEQ ID NO:11) | 863 | 1102 |
| Z21368_PEA_1_T24 (SEQ ID NO:12) | 863 | 1102 |
| Z21368_PEA_1_T5 (SEQ ID NO:13) | 701 | 940 |
| Z21368_PEA_1_T6 (SEQ ID NO:14) | 701 | 940 |

Segment cluster Z21368_PEA_1_node_2 (SEQ ID NO:1070) according to the present invention is supported by 15 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368 PEA_1_T5 (SEQ ID NO:13) and Z21368_PEA_1_T6 (SEQ ID NO:14). Table 91 below describes the starting and ending position of this segment on each transcript.

TABLE 91

Segment location on transcripts

| Transcript name | Segment starting position | Segment ending position |
| --- | --- | --- |
| Z21368_PEA_1_T10 (SEQ ID NO:9) | 1 | 300 |
| Z21368_PEA_1_T11 (SEQ ID NO:10) | 1 | 300 |
| Z21368_PEA_1_T23 (SEQ ID NO:11) | 1 | 300 |
| Z21368_PEA_1_T24 (SEQ ID NO:12) | 1 | 300 |
| Z21368_PEA_1_T5 (SEQ ID NO:13) | 1 | 300 |
| Z21368_PEA_1_T6 (SEQ ID NO:14) | 1 | 300 |

Segment cluster Z21368_PEA_1_node_21 (SEQ ID NO:1071) according to the present invention is supported by 37 libraries. The number of libraries was determined as previously described. This segment can be found in the following transcript(s): Z21368_PEA_1_T10 (SEQ ID NO:9), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 92 below describes the starting and ending position of this segment on each transcript.

TABLE 92

Segment location on transcripts

| Transcript name | Segment starting position | Segment ending position |
|---|---|---|
| Z21368_PEA_1_T10 (SEQ ID NO:9) | 1103 | 1254 |
| Z21368_PEA_1_T23 (SEQ ID NO:11) | 1103 | 1254 |
| Z21368_PEA_1_T24 (SEQ ID NO:12) | 1103 | 1254 |
| Z21368_PEA_1_T5 (SEQ ID NO:13) | 941 | 1092 |
| Z21368_PEA_1_T6 (SEQ ID NO:14) | 941 | 1092 |
| Z21368_PEA_1_T9 (SEQ ID NO:15) | 728 | 879 |

Segment cluster Z21368_PEA_1_node_33 (SEQ ID NO:1072) according to the present invention is supported by 45 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:1), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 93 below describes the starting and ending position of this segment on each transcript.

TABLE 93

Segment location on transcripts

| Transcript name | Segment starting position | Segment ending position |
|---|---|---|
| Z21368_PEA_1_T10 (SEQ ID NO:9) | 1502 | 1677 |
| Z21368_PEA_1_T11 (SEQ ID NO:10) | 1424 | 1599 |
| Z21368_PEA_1_T23 (SEQ ID NO:11) | 1576 | 1751 |
| Z21368_PEA_1_T24 (SEQ ID NO:12) | 1576 | 1751 |
| Z21368_PEA_1_T5 (SEQ ID NO:13) | 1414 | 1589 |
| Z21368_PEA_1_T6 (SEQ ID NO:14) | 1414 | 1589 |
| Z21368_PEA_1_T9 (SEQ ID NO:15) | 1201 | 1376 |

Segment cluster Z21368_PEA_1_node_36 (SEQ ID NO:1073) according to the present invention is supported by 44 libraries. The number of libraries was determined as previously described. This segment can be found in the following transcript(s): Z21368_PEA_1_T10 (SEQ ID NO:9), Z21368_PEA_1_T11 (SEQ ID NO: 10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 94 below describes the starting and ending position of this segment on each transcript.

TABLE 94

Segment location on transcripts

| Transcript name | Segment starting position | Segment ending position |
|---|---|---|
| Z21368_PEA_1_T10 (SEQ ID NO:9) | 1678 | 1806 |
| Z21368_PEA_1_T11 (SEQ ID NO:10) | 1600 | 1728 |
| Z21368_PEA_1_T23 (SEQ ID NO:11) | 1752 | 1880 |
| Z21368_PEA_1_T24 (SEQ ID NO:12) | 1752 | 1880 |
| Z21368_PEA_1_T5 (SEQ ID NO:13) | 1590 | 1718 |
| Z21368_PEA_1_T6 (SEQ ID NO:14) | 1590 | 1718 |
| Z21368_PEA_1_T9 (SEQ ID NO:15) | 1377 | 1505 |

Segment cluster Z21368_PEA_1_node_37 (SEQ ID NO:1074) according to the present invention is supported by 3 libraries. The number of libraries was determined as previously described. This segment can be found in the following transcript(s): Z21368_PEA_1_T24 (SEQ ID NO:12). Table 95 below describes the starting and ending position of this segment on each transcript.

TABLE 95

Segment location on transcripts

| Transcript name | Segment starting position | Segment ending position |
|---|---|---|
| Z21368_PEA_1_T24 (SEQ ID NO:12) | 1881 | 2159 |

Segment cluster Z21368_PEA_1_node_39 (SEQ ID NO:1075) according to the present invention is supported by 5 libraries. The number of libraries was determined as previously described. This segment can be found in the following transcript(s): Z21368_PEA_1_T23 (SEQ ID NO:11) and Z21368_PEA_1_T24 (SEQ ID NO:12). Table 96 below describes the starting and ending position of this segment on each transcript.

TABLE 96

Segment location on transcripts

| Transcript name | Segment starting position | Segment ending position |
|---|---|---|
| Z21368_PEA_1_T23 (SEQ ID NO:11) | 1938 | 2790 |
| Z21368_PEA_1_T24 (SEQ ID NO:12) | 2217 | 3069 |

Segment cluster Z21368_PEA_1_node_4 (SEQ ID NO:1076) according to the present invention is supported by 13 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11) and Z21368_PEA_1_T24 (SEQ ID NO:12). Table 97 below describes the starting and ending position of this segment on each transcript.

TABLE 97

Segment location on transcripts

| Transcript name | Segment starting position | Segment ending position |
|---|---|---|
| Z21368_PEA_1_T10 (SEQ ID NO:9) | 301 | 462 |
| Z21368_PEA_1_T11 (SEQ ID NO:10) | 301 | 462 |
| Z21368_PEA_1_T23 (SEQ ID NO:11) | 301 | 462 |
| Z21368_PEA_1_T24 (SEQ ID NO:12) | 301 | 462 |

Segment cluster Z21368_PEA_1_node_41 (SEQ ID NO:1077) according to the present invention is supported by 49 libraries. The number of libraries was determined as previously described. This segment can be found in the following transcript(s): Z21368 PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 98 below describes the starting and ending position of this segment on each transcript.

TABLE 98

Segment location on transcripts

| Transcript name | Segment starting position | Segment ending position |
|---|---|---|
| Z21368_PEA_1_T10 (SEQ ID NO:9) | 1864 | 1993 |
| Z21368_PEA_1_T11 (SEQ ID NO:10) | 1786 | 1915 |
| Z21368_PEA_1_T5 (SEQ ID NO:13) | 1776 | 1905 |
| Z21368_PEA_1_T6 (SEQ ID NO:14) | 1776 | 1905 |
| Z21368_PEA_1_T9 (SEQ ID NO:15) | 1563 | 1692 |

Segment cluster Z21368_PEA_1_node_43 (SEQ ID NO:1078) according to the present invention is supported by 52 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 99 below describes the starting and ending position of this segment on each transcript.

TABLE 99

Segment location on transcripts

| Transcript name | Segment starting position | Segment ending position |
|---|---|---|
| Z21368_PEA_1_T10 (SEQ ID NO:9) | 1994 | 2210 |
| Z21368_PEA_1_T11 (SEQ ID NO:10) | 1916 | 2132 |
| Z21368_PEA_1_T5 (SEQ ID NO:13) | 1906 | 2122 |
| Z21368_PEA_1_T6 (SEQ ID NO:14) | 1906 | 2122 |
| Z21368_PEA_1_T9 (SEQ ID NO:15) | 1693 | 1909 |

Segment cluster Z21368_PEA_1_node_45 (SEQ ID NO:1079) according to the present invention is supported by 64 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 100 below describes the starting and ending position of this segment on each transcript.

TABLE 100

Segment location on transcripts

| Transcript name | Segment starting position | Segment ending position |
|---|---|---|
| Z21368_PEA_1_T10 (SEQ ID NO:9) | 2211 | 2466 |
| Z21368_PEA_1_T11 (SEQ ID NO:10) | 2133 | 2388 |
| Z21368_PEA_1_T5 (SEQ ID NO:13) | 2123 | 2378 |
| Z21368_PEA_1_T6 (SEQ ID NO:14) | 2123 | 2378 |
| Z21368_PEA_1_T9 (SEQ ID NO:15) | 1910 | 2165 |

Segment cluster Z21368_PEA_1_node_53 (SEQ ID NO:1080) according to the present invention is supported by 60 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 101 below describes the starting and ending position of this segment on each transcript.

TABLE w101

Segment location on transcripts

| Transcript name | Segment starting position | Segment ending position |
|---|---|---|
| Z21368_PEA_1_T10 (SEQ ID NO:9) | 2725 | 2900 |
| Z21368_PEA_1_T11 (SEQ ID NO:10) | 2647 | 2822 |
| Z21368_PEA_1_T5 (SEQ ID NO:13) | 2637 | 2812 |
| Z21368_PEA_1_T6 (SEQ ID NO:14) | 2637 | 2812 |
| Z21368_PEA_1_T9 (SEQ ID NO:15) | 2424 | 2599 |

Segment cluster Z21368_PEA_1_node_56 (SEQ ID NO:1081) according to the present invention is supported by 50 libraries. The number of libraries was determined as previously described. This segment can be found in the following transcript(s): Z21368_PEA_1_T10 (SEQ ID NO:9), Z21368_PEA_1_T11 (SEQ ID NO:10) and Z21368_PEA_1_T9 (SEQ ID NO:15). Table 102 below describes the starting and ending position of this segment on each transcript.

TABLE 102

Segment location on transcripts

| Transcript name | Segment starting position | Segment ending position |
|---|---|---|
| Z21368_PEA_1_T10 (SEQ ID NO:9) | 2901 | 3043 |
| Z21368_PEA_1_T11 (SEQ ID NO:10) | 2823 | 2965 |
| Z21368_PEA_1_T9 (SEQ ID NO:15) | 2600 | 2742 |

Segment cluster Z21368_PEA_1_node_58 (SEQ ID NO:1082) according to the present invention is supported by 71 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 103 below describes the starting and ending position of this segment on each transcript.

TABLE 103

Segment location on transcripts

| Transcript name | Segment starting position | Segment ending position |
|---|---|---|
| Z21368_PEA_1_T10 (SEQ ID NO:9) | 3044 | 3167 |
| Z21368_PEA_1_T11 (SEQ ID NO:10) | 2966 | 3089 |
| Z21368_PEA_1_T5 (SEQ ID NO:13) | 2813 | 2936 |
| Z21368_PEA_1_T6 (SEQ ID NO:14) | 2813 | 2936 |
| Z21368_PEA_1_T9 (SEQ ID NO:15) | 2743 | 2866 |

Segment cluster Z21368_PEA_1_node_66 (SEQ ID NO:1083) according to the present invention is supported by 142 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 104 below describes the starting and ending position of this segment on each transcript.

TABLE 104

Segment location on transcripts

| Transcript name | Segment starting position | Segment ending position |
|---|---|---|
| Z21368_PEA_1_T10 (SEQ ID NO:9) | 3202 | 3789 |
| Z21368_PEA_1_T11 (SEQ ID NO:10) | 3124 | 3711 |
| Z21368_PEA_1_T5 (SEQ ID NO:13) | 2971 | 3558 |
| Z21368_PEA_1_T6 (SEQ ID NO:14) | 2971 | 3558 |
| Z21368_PEA_1_T9 (SEQ ID NO:15) | 2901 | 3488 |

Segment cluster Z21368_PEA_1_node_67 (SEQ ID NO:1084) according to the present invention is supported by 181 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 105 below describes the starting and ending position of this segment on each transcript.

TABLE 105

Segment location on transcripts

| Transcript name | Segment starting position | Segment ending position |
|---|---|---|
| Z21368_PEA_1_T10 (SEQ ID NO:9) | 3790 | 4374 |
| Z21368_PEA_1_T11 (SEQ ID NO:10) | 3712 | 4296 |
| Z21368_PEA_1_T5 (SEQ ID NO:13) | 3559 | 4143 |
| Z21368_PEA_1_T6 (SEQ ID NO:14) | 3559 | 4143 |
| Z21368_PEA_1_T9 (SEQ ID NO:15) | 3489 | 4073 |

Segment cluster Z21368_PEA_1_node_69 (SEQ ID NO:1085) according to the present invention is supported by 150 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 106 below describes the starting and ending position of this segment on each transcript.

TABLE 106

Segment location on transcripts

| Transcript name | Segment starting position | Segment ending position |
|---|---|---|
| Z21368_PEA_1_T10 (SEQ ID NO:9) | 4428 | 4755 |
| Z21368_PEA_1_T11 (SEQ ID NO:10) | 4350 | 4677 |
| Z21368_PEA_1_T5 (SEQ ID NO:13) | 4197 | 5384 |
| Z21368_PEA_1_T6 (SEQ ID NO:14) | 4197 | 4524 |
| Z21368_PEA_1_T9 (SEQ ID NO:15) | 4127 | 4454 |

According to an optional embodiment of the present invention, short segments related to the above cluster are also provided. These segments are up to about 120 bp in length, and so are included in a separate description.

Segment cluster Z21368_PEA_1_node_11 (SEQ ID NO:1086) according to the present invention is supported by 26 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 107 below describes the starting and ending position of this segment on each transcript.

TABLE 107

Segment location on transcripts

| Transcript name | Segment starting position | Segment ending position |
|---|---|---|
| Z21368_PEA_1_T10 (SEQ ID NO:9) | 558 | 602 |
| Z21368_PEA_1_T11 (SEQ ID NO:10) | 558 | 602 |
| Z21368_PEA_1_T23 (SEQ ID NO:11) | 558 | 602 |
| Z21368_PEA_1_T24 (SEQ ID NO:12) | 558 | 602 |
| Z21368_PEA_1_T5 (SEQ ID NO:13) | 396 | 440 |
| Z21368_PEA_1_T6 (SEQ ID NO:14) | 396 | 440 |
| Z21368_PEA_1_T9 (SEQ ID NO:15) | 423 | 467 |

Segment cluster Z21368_PEA_1_node_12 (SEQ ID NO:1087) according to the present invention is supported by 23 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 108 below describes the starting and ending position of this segment on each transcript.

TABLE 108

Segment location on transcripts

| Transcript name | Segment starting position | Segment ending position |
|---|---|---|
| Z21368_PEA_1_T10 (SEQ ID NO:9) | 603 | 630 |
| Z21368_PEA_1_T11 (SEQ ID NO:10) | 603 | 630 |
| Z21368_PEA_1_T23 (SEQ ID NO:11) | 603 | 630 |
| Z21368_PEA_1_T24 (SEQ ID NO:12) | 603 | 630 |
| Z21368_PEA_1_T5 (SEQ ID NO:13) | 441 | 468 |
| Z21368_PEA_1_T6 (SEQ ID NO:14) | 441 | 468 |
| Z21368_PEA_1_T9 (SEQ ID NO:15) | 468 | 495 |

Segment cluster Z21368_PEA_1_node_16 (SEQ ID NO:1088) according to the present invention can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 109 below describes the starting and ending position of this segment on each transcript.

TABLE 109

Segment location on transcripts

| Transcript name | Segment starting position | Segment ending position |
|---|---|---|
| Z21368_PEA_1_T10 (SEQ ID NO:9) | 808 | 822 |
| Z21368_PEA_1_T11 (SEQ ID NO:10) | 808 | 822 |
| Z21368_PEA_1_T23 (SEQ ID NO:11) | 808 | 822 |
| Z21368_PEA_1_T24 (SEQ ID NO:12) | 808 | 822 |
| Z21368_PEA_1_T5 (SEQ ID NO:13) | 646 | 660 |
| Z21368_PEA_1_T6 (SEQ ID NO:14) | 646 | 660 |
| Z21368_PEA_1_T9 (SEQ ID NO:15) | 673 | 687 |

Segment cluster Z21368_PEA_1_node_17 (SEQ ID NO:1089) according to the present invention is supported by 19 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_L_T5 (SEQ ID NO:13), Z21368_PEA_1_T6 (SEQ ID NO:14) and Z21368_PEA_1_T9 (SEQ ID NO:15). Table 110 below describes the starting and ending position of this segment on each transcript.

TABLE 110

Segment location on transcripts

| Transcript name | Segment starting position | Segment ending position |
|---|---|---|
| Z21368_PEA_1_T10 (SEQ ID NO:9) | 823 | 862 |
| Z21368_PEA_1_T11 (SEQ ID NO:10) | 823 | 862 |
| Z21368_PEA_1_T23 (SEQ ID NO:11) | 823 | 862 |
| Z21368_PEA_1_T24 (SEQ ID NO:12) | 823 | 862 |
| Z21368_PEA_1_T5 (SEQ ID NO:13) | 661 | 700 |
| Z21368_PEA_1_T6 (SEQ ID NO:14) | 661 | 700 |
| Z21368_PEA_1_T9 (SEQ ID NO:15) | 688 | 727 |

Segment cluster Z21368_PEA_1_node_23 (SEQ ID NO:1090) according to the present invention is supported by 36 libraries. The number of libraries was determined as previously described. This segment can be found in the following transcript(s): Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 111 below describes the starting and ending position of this segment on each transcript.

TABLE 111

Segment location on transcripts

| Transcript name | Segment starting position | Segment ending position |
|---|---|---|
| Z21368_PEA_1_T11 (SEQ ID NO:10) | 1103 | 1176 |
| Z21368_PEA_1_T23 (SEQ ID NO:11) | 1255 | 1328 |
| Z21368_PEA_1_T24 (SEQ ID NO:12) | 1255 | 1328 |
| Z21368_PEA_1_T5 (SEQ ID NO:13) | 1093 | 1166 |
| Z21368_PEA_1_T6 (SEQ ID NO:14) | 1093 | 1166 |
| Z21368_PEA_1_T9 (SEQ ID NO:15) | 880 | 953 |

Segment cluster Z21368_PEA_1_node_24 (SEQ ID NO:1091) according to the present invention is supported by 36 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 112 below describes the starting and ending position of this segment on each transcript.

TABLE 112

Segment location on transcripts

| Transcript name | Segment starting position | Segment ending position |
|---|---|---|
| Z21368_PEA_1_T10 (SEQ ID NO:9) | 1255 | 1350 |
| Z21368_PEA_1_T11 (SEQ ID NO:10) | 1177 | 1272 |
| Z21368_PEA_1_T23 (SEQ ID NO:11) | 1329 | 1424 |
| Z21368_PEA_1_T24 (SEQ ID NO:12) | 1329 | 1424 |
| Z21368_PEA_1_T5 (SEQ ID NO:13) | 1167 | 1262 |

TABLE 112-continued

Segment location on transcripts

| Transcript name | Segment starting position | Segment ending position |
|---|---|---|
| Z21368_PEA_1_T6 (SEQ ID NO:14) | 1167 | 1262 |
| Z21368_PEA_1_T9 (SEQ ID NO:15) | 954 | 1049 |

Segment cluster Z21368_PEA_1_node_30 (SEQ ID NO:1092) according to the present invention is supported by 39 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 113 below describes the starting and ending position of this segment on each transcript.

TABLE 113

Segment location on transcripts

| Transcript name | Segment starting position | Segment ending position |
|---|---|---|
| Z21368_PEA_1_T10 (SEQ ID NO:9) | 1351 | 1409 |
| Z21368_PEA_1_T11 (SEQ ID NO:10) | 1273 | 1331 |
| Z21368_PEA_1_T23 (SEQ ID NO:11) | 1425 | 1483 |
| Z21368_PEA_1_T24 (SEQ ID NO:12) | 1425 | 1483 |
| Z21368_PEA_1_T5 (SEQ ID NO:13) | 1263 | 1321 |
| Z21368_PEA_1_T6 (SEQ ID NO:14) | 1263 | 1321 |
| Z21368_PEA_1_T9 (SEQ ID NO:15) | 1050 | 1108 |

Segment cluster Z21368_PEA_1_node_31 (SEQ ID NO:1093) according to the present invention is supported by 40 libraries. The number of libraries was determined as previously described. This segment can be found in the following transcript(s): Z21368 PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 114 below describes the starting and ending position of this segment on each transcript.

TABLE 114

Segment location on transcripts

| Transcript name | Segment starting position | Segment ending position |
|---|---|---|
| Z21368_PEA_1_T10 (SEQ ID NO:9) | 1410 | 1501 |
| Z21368_PEA_1_T11 (SEQ ID NO:10) | 1332 | 1423 |
| Z21368_PEA_1_T23 (SEQ ID NO:11) | 1484 | 1575 |
| Z21368_PEA_1_T24 (SEQ ID NO:12) | 1484 | 1575 |

TABLE 114-continued

Segment location on transcripts

| Transcript name | Segment starting position | Segment ending position |
|---|---|---|
| Z21368_PEA_1_T5 (SEQ ID NO:13) | 1322 | 1413 |
| Z21368_PEA_1_T6 (SEQ ID NO:14) | 1322 | 1413 |
| Z21368_PEA_1_T9 (SEQ ID NO:15) | 110 | 1200 |

Segment cluster Z21368_PEA_1_node_38 (SEQ ID NO:1094) according to the present invention is supported by 45 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 115 below describes the starting and ending position of this segment on each transcript.

TABLE 115

Segment location on transcripts

| Transcript name | Segment starting position | Segment ending position |
|---|---|---|
| Z21368_PEA_1_T10 (SEQ ID NO:9) | 1807 | 1863 |
| Z21368_PEA_1_T11 (SEQ ID NO:10) | 1729 | 1785 |
| Z21368_PEA_1_T23 (SEQ ID NO:11) | 1881 | 1937 |
| Z21368_PEA_1_T24 (SEQ ID NO:12) | 2160 | 2216 |
| Z21368_PEA_1_T5 (SEQ ID NO:13) | 1719 | 1775 |
| Z21368_PEA_1_T6 (SEQ ID NO:14) | 1719 | 1775 |
| Z21368_PEA_1_T9 (SEQ ID NO:15) | 1506 | 1562 |

Segment cluster Z21368_PEA_1_node_47 (SEQ ID NO:1095) according to the present invention is supported by 61 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 116 below describes the starting and ending position of this segment on each transcript.

TABLE 116

Segment location on transcripts

| Transcript name | Segment starting position | Segment ending position |
|---|---|---|
| Z21368_PEA_1_T10 (SEQ ID NO:9) | 2467 | 2563 |
| Z21368_PEA_1_T11 (SEQ ID NO:10) | 2389 | 2485 |
| Z21368_PEA_1_T5 (SEQ ID NO:13) | 2379 | 2475 |

TABLE 116-continued

Segment location on transcripts

| Transcript name | Segment starting position | Segment ending position |
|---|---|---|
| Z21368_PEA_1_T6 (SEQ ID NO:14) | 2379 | 2475 |
| Z21368_PEA_1_T9 (SEQ ID NO:15) | 2166 | 2262 |

Segment cluster Z21368_PEA_1_node_49 (SEQ ID NO:1096) according to the present invention is supported by 57 libraries. The number of libraries was determined as previously described. This segment can be found in the following transcript(s): Z21368_PEA_1_T10 (SEQ ID NO:9), Z21368_PEA_1_T1 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 117 below describes the starting and ending position of this segment on each transcript.

TABLE 117

Segment location on transcripts

| Transcript name | Segment starting position | Segment ending position |
|---|---|---|
| Z21368_PEA_1_T10 (SEQ ID NO:9) | 2564 | 2658 |
| Z21368_PEA_1_T11 (SEQ ID NO:10) | 2486 | 2580 |
| Z21368_PEA_1_T5 (SEQ ID NO:13) | 2476 | 2570 |
| Z21368_PEA_1_T6 (SEQ ID NO:14) | 2476 | 2570 |
| Z21368_PEA_1_T9 (SEQ ID NO:15) | 2263 | 2357 |

Segment cluster Z21368_PEA_1_node_51 (SEQ ID NO:1097) according to the present invention is supported by 46 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 118 below describes the starting and ending position of this segment on each transcript.

TABLE 118

Segment location on transcripts

| Transcript name | Segment starting position | Segment ending position |
|---|---|---|
| Z21368_PEA_1_T10 (SEQ ID NO:9) | 2659 | 2724 |
| Z21368_PEA_1_T11 (SEQ ID NO:10) | 2581 | 2646 |
| Z21368_PEA_1_T5 (SEQ ID NO:13) | 2571 | 2636 |
| Z21368_PEA_1_T6 (SEQ ID NO:14) | 2571 | 2636 |
| Z21368_PEA_1_T9 (SEQ ID NO:15) | 2358 | 2423 |

Segment cluster Z21368_PEA_1_node_61 (SEQ ID NO:1098) according to the present invention is supported by 61 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 119 below describes the starting and ending position of this segment on each transcript.

TABLE 119

Segment location on transcripts

| Transcript name | Segment starting position | Segment ending position |
|---|---|---|
| Z21368_PEA_1_T10 (SEQ ID NO:9) | 3168 | 3201 |
| Z21368_PEA_1_T11 (SEQ ID NO:10) | 3090 | 3123 |
| Z21368_PEA_1_T5 (SEQ ID NO:13) | 2937 | 2970 |
| Z21368_PEA_1_T6 (SEQ ID NO:14) | 2937 | 2970 |
| Z21368_PEA_1_T9 (SEQ ID NO:15) | 2867 | 2900 |

Segment cluster Z21368_PEA_1_node_68 (SEQ ID NO:1099) according to the present invention is supported by 87 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T5 (SEQ ID NO:13), Z21368_PEA_1_T6 (SEQ ID NO:14) and Z21368_PEA_1_T9 (SEQ ID NO:15). Table 120 below describes the starting and ending position of this segment on each transcript.

TABLE 120

Segment location on transcripts

| Transcript name | Segment starting position | Segment ending position |
|---|---|---|
| Z21368_PEA_1_T10 (SEQ ID NO:9) | 4375 | 4427 |
| Z21368_PEA_1_T11 (SEQ ID NO:10) | 4297 | 4349 |
| Z21368_PEA_1_T5 (SEQ ID NO:13) | 4144 | 4196 |
| Z21368_PEA_1_T6 (SEQ ID NO:14) | 4144 | 4196 |
| Z21368_PEA_1_T9 (SEQ ID NO:15) | 4074 | 4126 |

Segment cluster Z21368_PEA_1_node_7 (SEQ ID NO:1100) according to the present invention is supported by 29 libraries. The number of libraries was determined as previously described. This segment can be found in the following transcript(s): Z21368_PEA_1_T10 (SEQ ID NO:9), Z21368_PEA_1_T11 (SEQ ID NO:10), Z21368_PEA_1_T23 (SEQ ID NO:11), Z21368_PEA_1_T24 (SEQ ID NO:12), Z21368_PEA_1_T5 (SEQ ID NO:13), Z21368_PEA_1_T6 (SEQ ID NO:14) and Z21368_PEA_1_T9 (SEQ ID NO:15). Table 121 below describes the starting and ending position of this segment on each transcript.

TABLE 121

Segment location on transcripts

| Transcript name | Segment starting position | Segment ending position |
|---|---|---|
| Z21368_PEA_1_T10 (SEQ ID NO:9) | 463 | 557 |
| Z21368_PEA_1_T11 (SEQ ID NO:10) | 463 | 557 |
| Z21368_PEA_1_T23 (SEQ ID NO:11) | 463 | 557 |
| Z21368_PEA_1_T24 (SEQ ID NO:12) | 463 | 557 |
| Z21368_PEA_1_T5 (SEQ ID NO:13) | 301 | 395 |
| Z21368_PEA_1_T6 (SEQ ID NO:14) | 301 | 395 |
| Z21368_PEA_1_T9 (SEQ ID NO:15) | 328 | 422 |

Overexpression of at least a portion of this cluster was determined according to oligonucleotides and one or more chips. The results were as follows: Oligonucleotide Z21368_0_0_61857 (SEQ ID NO: 207) was on the TAA chip and was found to be overexpressed in Lung cancer (general), in Lung adenocarcinoma, and in Lung squamous cell cancer.

Variant protein alignment to the previously known protein:

Sequence name: /tmp/5ER3vIMKE2/9L0Y7lDlTQ: SUL1_HUMAN (SEQ ID NO:1419)

Sequence documentation:

Alignment of: Z21368_PEA_1_P2 (SEQ ID NO:1289) x SUL1_HUMAN (SEQ ID NO:1419)

Alignment segment 1/1:

| | |
|---|---|
| Quality: 7664.00 | Escore: 0 |
| Matching length: 761 | Total length: 761 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT  50
    |||||||||||||||||||||||||||||||||||||||||||||||||| 
  1 MKYSCCALVLAVLGTELLGSLCSTVRSPRFRGRIQQERKNIRPNIILVLT  50

51 DDQDVELGSLQVMNKTRKIMEHGGATFINAFVTTPMCCPSRSSMLTGKYV 100
    |||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRTAFFGKYLNEYNGS 150
    |||||||||||||||||||||||||||||||||||||||||||||||||
101 HNHNVYTNNENCSSPSWQAMHEPRTFAVYLNNTGYRTAFFGKYLNEYNGS 150

151 YIPPGWREWLGLIKNSRFYNYTVCRNGIKEKHGFDYAKDYFTDLITNESI 200
    |||||||||||||||||||||||||||||||||||||||||||||||||
151 YIPPGWREWLGLIKNSRFYNYTVCRNGIKEKHGFDYAKDYFTDLITNESI 200

201 NYFKMSKRMYPHRPVMMVISHAAPHGPEDSAPQFSKLYPNASQHITPSYN 250
    |||||||||||||||||||||||||||||||||||||||||||||||||
201 NYFKMSKRMYPHRPVMMVISHAAPHGPEDSAPQFSKLYPNASQHITPSYN 250

251 YAPNMDKHWIMQYTGPMLPIHMEFTNILQRKRLQTLMSVDDSVERLYNML 300
    |||||||||||||||||||||||||||||||||||||||||||||||||
251 YAPNMDKHWIMQYTGPMLPIHMEFTNILQRKRLQTLMSVDDSVERLYNML 300

301 VETGELENTYIIYTADHGYHIGQFGLVKGKSMPYDFDIRVPFFIRGPSVE 350
    |||||||||||||||||||||||||||||||||||||||||||||||||
301 VETGELENTYIIYTADHGYHIGQFGLVKGKSMPYDFDIRVPFFIRGPSVE 350

351 PGSIVPQIVLNIDLAPTILDIAGLDTPPDVDGKSVLKLLDPEKPGNRFRT 400
    |||||||||||||||||||||||||||||||||||||||||||||||||
351 PGSIVPQIVLNIDLAPTILDIAGLDTPPDVDGKSVLKLLDPEKPGNRFRT 400

401 NKKAKIWRDTFLVERGKFLRKKEESSKNIQQSNHLPKYERVKELCQQARY 450
    |||||||||||||||||||||||||||||||||||||||||||||||||
401 NKKAKIWRDTFLVERGKFLRKKEESSKNIQQSNHLPKYERVKELCQQARY 450

451 QTACEQPGQKWQCIEDTSGKLRIHKCKGPSDLLTVRQSTRNLYARGFHDK 500
    |||||||||||||||||||||||||||||||||||||||||||||||||
451 QTACEQPGQKWQCIEDTSGKLRIHKCKGPSDLLTVRQSTRNLYARGFHDK 500

501 DKECSCRESGYRASRSQRKSQRQFLRNQGTPKYKPRFVHTRQTRSLSVEF 550
    |||||||||||||||||||||||||||||||||||||||||||||||||
501 DKECSCRESGYRASRSQRKSQRQFLRNQGTPKYKPRFVHTRQTRSLSVEF 550

551 EGEIYDINLEEEEELQVLQPRNIAKRHDEGHKGPRDLQASSGGNRGRMLA 600
    |||||||||||||||||||||||||||||||||||||||||||||||||
551 EGEIYDINLEEEEELQVLQPRNIAKRHDEGHKGPRDLQASSGGNRGRMLA 600

601 DSSNAVGPPTTVRVTHKCFILPNDSIHCERELYQSARAWKDHKAYIDKEI 650
    |||||||||||||||||||||||||||||||||||||||||||||||||
601 DSSNAVGPPTTVRVTHKCFILPNDSIHCERELYQSARAWKDHKAYIDKEI 650
```

```
651 EALQDKIKNLREVRGHLKRRKPEECSCSKQSYYNKEKGVKKQEKLKSHLH 700
    |||||||||||||||||||||||||||||||||||||||||||||||||
651 EALQDKIKNLREVRGHLKRRKPEECSCSKQSYYNKEKGVKKQEKLKSHLH 700

701 PFKEAAQEVDSKLQLFKENNRRRKKERKEKRRQRKGEECSLPGLTCFTHD 750
    |||||||||||||||||||||||||||||||||||||||||||||||||
701 PFKEAAQEVDSKLQLFKENNRRRKKERKEKRRQRKGEECSLPGLTCFTHD 750

751 NNHWQTAPFWN                                        761
    |||||||||||
751 NNHWQTAPFWN                                        761
```

Sequence name: /tmp/tt3yfXIUKV/YxSTFWr66h:Q7Z2W2 (SEQ ID NO:1697)

Sequence documentation:

Alignment of: Z21368_PEA_1_P5 (SEQ ID NO:1290) x Q7Z2W2 (SEQ ID NO:1697)

Alignment segment 1/1:

| Quality: 7869.00 | Escore: 0 |
|---|---|
| Matching length: 791 | Total length: 871 |

-continued

| Matching Percent Similarity: 99.87 | Matching Percent Identity: 99.87 |
|---|---|
| Total Percent Similarity: 90.70 | Total Percent Identity: 90.70 |
| Gaps: 1 | |

Alignment:

```
  1 MKYSCCALVLAVLGTELLGSLCSTVRSPRFRGRIQQERKNIRPNIILVLT 50
    |||||||||||||||||||||||||||||||||||||||||||||||||
  1 MKYSCCALVLAVLGTELLGSLCSTVRSPRFRGRIQQERKNIRPNIILVLT 50

51 DDQDVELA.......................................... 58
    ||||||||
 51 DDQDVELGSLQVMNKTRKIMEHGGATFINAFVTTPMCCPSRSSMLTGKYV 100

59 ...............................FFGKYLNEYNGS 70
                                   ||||||||||||
101 HNHNVYTNNENCSSPSWQAMHEPRTFAVYLNNTGYRTVFFGKYLNEYNGS 150

71 YIPPGWREWLGLIKNSRFYNYTVCRNGIKEKHGFDYAKDYFTDLITNESI 120
    |||||||||||||||||||||||||||||||||||||||||||||||||
151 YIPPGWREWLGLIKNSRFYNYTVCRNGIKEKHGFDYAKDYFTDLITNESI 200

121 NYFKMSKRMYPHRPVMMVISHAAPHGPEDSAPQFSKLYPNASQHITPSYN 170
    |||||||||||||||||||||||||||||||||||||||||||||||||
201 NYFKMSKRMYPHRPVMMVISHAAPHGPEDSAPQFSKLYPNASQHITPSYN 250

171 YAPNMDKHWIMQYTGPMLPIHMEFTNILQRKRLQTLMSVDDSVERLYNML 220
    |||||||||||||||||||||||||||||||||||||||||||||||||
251 YAPNMDKHWIMQYTGPMLPIHMEFTNILQRKRLQTLMSVDDSVERLYNML 300

221 VETGELENTYIIYTADHGYHIGQFGLVKGKSMPYDFDIRVPFFIRGPSVE 270
    |||||||||||||||||||||||||||||||||||||||||||||||||
301 VETGELENTYIIYTADHGYHIGQFGLVKGKSMPYDFDIRVPFFIRGPSVE 350

271 PGSIVPQIVLNIDLAPTILDIAGLDTPPDVDGKSVLKLLDPEKPGNRFRT 320
    |||||||||||||||||||||||||||||||||||||||||||||||||
351 PGSIVPQIVLNIDLAPTILDIAGLDTPPDVDGKSVLKLLDPEKPGNRFRT 400

321 NKKAKIWRDTFLVERGKFLRKKEESSKNIQQSNHLPKYERVKELCQQARY 370
    |||||||||||||||||||||||||||||||||||||||||||||||||
401 NKKAKIWRDTFLVERGKFLRKKEESSKNIQQSNHLPKYERVKELCQQARY 450

371 QTACEQPGQKWQCIEDTSGKLRIHKCKGPSDLLTVRQSTRNLYARGFHDK 420
    |||||||||||||||||||||||||||||||||||||||||||||||||
451 QTACEQPGQKWQCIEDTSGKLRIHKCKGPSDLLTVRQSTRNLYARGFHDK 500

421 DKECSCRESGYRASRSQRKSQRQFLRNQGTPKYKPRFVHTRQTRSLSVEF 470
    |||||||||||||||||||||||||||||||||||||||||||||||||
501 DKECSCRESGYRASRSQRKSQRQFLRNQGTPKYKPRFVHTRQTRSLSVEF 550

471 EGEIYDINLEEEEELQVLQPRNIAKRHDEGHKGPRDLQASSGGNRGRMLA 520
    |||||||||||||||||||||||||||||||||||||||||||||||||
551 EGEIYDINLEEEEELQVLQPRNIAKRHDEGHKGPRDLQASSGGNRGRMLA 600
```

-continued

```
521 DSSNAVGPPTTVRVTHKCFILPNDSIHCERELYQSARAWKDHKAYIDKEI 570
    ||||||||||||||||||||||||||||||||||||||||||||||||||
601 DSSNAVGPPTTVRVTHKCFILPNDSIHCERELYQSARAWKDHKAYIDKEI 650

571 EALQDKIKNLREVRGHLKRRKPEECSCSKQSYYNKEKGVKKQEKLKSHLH 620
    ||||||||||||||||||||||||||||||||||||||||||||||||||
651 EALQDKIKNLREVRGHLKRRKPEECSCSKQSYYNKEKGVKKQEKLKSHLH 700

621 PFKEAAQEVDSKLQLFKENNRRRKKERKEKRRQRKGEECSLPGLTCFTHD 670
    ||||||||||||||||||||||||||||||||||||||||||||||||||
701 PFKEAAQEVDSKLQLFKENNRRRKKERKEKRRQRKGEECSLPGLTCFTHD 750

671 NNHWQTAPFWNLGSFCACTSSNNNTYWCLRTVNETHNFLFCEFATGFLEY 720
    ||||||||||||||||||||||||||||||||||||||||||||||||||
751 NNHWQTAPFWNLGSFCACTSSNNNTYWCLRTVNETHNFLFCEFATGFLEY 800

721 FDMNTDPYQLTNTVHTVERGILNQLHVQLMELRSCQGYKQCNPRPKNLDV 770
    ||||||||||||||||||||||||||||||||||||||||||||||||||
801 FDMNTDPYQLTNTVHTVERGILNQLHVQLMELRSCQGYKQCNPRPKNLDV 850

771 GNKDGGSYDLHRGQLWDGWEG                              791
    |||||||||||||||||||||
801 GNKDGGSYDLHRGQLWDGWEG                              871
```

Sequence name: /tmp/tt3yfXIUKV/YxSTFWr66h: AAH12997 (SEQ ID NO:1698)

Sequence documentation:

Alignment of: Z21368_PEA_1_P5 (SEQ ID NO:1290) x AAH12997 (SEQ ID NO:1698)

Alignment segment 1/1:

| | |
|---|---|
| Quality: 420.00 | Escore: 0 |
| Matching length: 40 | Total length: 40 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
752 LRSCQGYKQCNPRPKNLDVGNKDGGSYDLHRGQLWDGWEG           791
    ||||||||||||||||||||||||||||||||||||||||
  1 LRSCQGYKQCNPRPKNLDVGNKDGGSYDLHRGQLWDGWEG            40
```

Sequence name: /tmp/tt3yfXIUKV/YxSTFWr66h: SUL1_HUMAN (SEQ ID NO:1419)

Sequence documentation:

Alignment of: Z21368_PEA_1_P5 (SEQ ID NO:1290) x SUL1_HUMAN (SEQ ID NO:1419)

Alignment segment 1/1:

| | |
|---|---|
| Quality: 7878.00 | Escore: 0 |
| Matching length: 791 | Total length: 871 |
| Matching Percent Similarity: 100.00 | Matching Percent Identity: 100.00 |
| Total Percent Similarity: 90.82 | Total Percent Identity: 90.82 |
| Gaps: 1 | |

Alignment:

```
  1 MKYSCCALVLAVLGTELLGSLCSTVRSPRFRGRIQQERKNIRPNIILVLT  50
    ||||||||||||||||||||||||||||||||||||||||||||||||||
  1 MKYSCCALVLAVLGTELLGSLCSTVRSPRFRGRIQQERKNIRPNIILVLT  50

51 DDQDVEL...........................................  57
    |||||||
 51 DDQDVELGSLQVMNKTRKIMEHGGATFINAFVTTPMCCPSRSSMLTGKYV 100

58 ..........................................AFFGKYLNEYNGS  70
                                               ||||||||||||
101 HNHNVYTNNENCSSPSWQAMHEPRTFAVYLNNTGYRTAFFGKYLNEYNGS 150

71 YIPPGWREWLGLIKNSRFYNYTVCRNGIKEKHGFDYAKDYFTDLITNESI 120
    ||||||||||||||||||||||||||||||||||||||||||||||||||
151 YIPPGWREWLGLIKNSRFYNYTVCRNGIKEKHGFDYAKDYFTDLITNESI 200
```

-continued

```
121 NYFKMSKRMYPHRPVMMVISHAAPHGPEDSAPQFSKLYPNASQHITPSYN 170
    ||||||||||||||||||||||||||||||||||||||||||||||||||
201 NYFKMSKRMYPHRPVMMVISHAAPHGPEDSAPQFSKLYPNASQHITPSYN 250

171 YAPNMDKHWIMQYTGPMLPIHMEFTNILQRKRLQTLMSVDDSVERLYNML 220
    ||||||||||||||||||||||||||||||||||||||||||||||||||
251 YAPNMDKHWIMQYTGPMLPIHMEFTNILQRKRLQTLMSVDDSVERLYNML 300

221 VETGELENTYIIYTADHGYHIGQFGLVKGKSMPYDFDIRVPFFIRGPSVE 270
    ||||||||||||||||||||||||||||||||||||||||||||||||||
301 VETGELENTYIIYTADHGYHIGQFGLVKGKSMPYDFDIRVPFFIRGPSVE 350

271 PGSIVPQIVLNIDLAPTILDIAGLDTPPDVDGKSVLKLLDPEKPGNRFRT 320
    ||||||||||||||||||||||||||||||||||||||||||||||||||
351 PGSIVPQIVLNIDLAPTILDIAGLDTPPDVDGKSVLKLLDPEKPGNRFRT 400

321 NKKAKIWRDTFLVERGKFLRKKEESSKNIQQSNHLPKYERVKELCQQARY 370
    ||||||||||||||||||||||||||||||||||||||||||||||||||
401 NKKAKIWRDTFLVERGKFLRKKEESSKNIQQSNHLPKYERVKELCQQARY 450

371 QTACEQPGQKWQCIEDTSGKLRIHKCKGPSDLLTVRQSTRNLYARGFHDK 420
    ||||||||||||||||||||||||||||||||||||||||||||||||||
451 QTACEQPGQKWQCIEDTSGKLRIHKCKGPSDLLTVRQSTRNLYARGFHDK 500

421 DKECSCRESGYRASRSQRKSQRQFLRNQGTPKYKPRFVHTRQTRSLSVEF 470
    ||||||||||||||||||||||||||||||||||||||||||||||||||
501 DKECSCRESGYRASRSQRKSQRQFLRNQGTPKYKPRFVHTRQTRSLSVEF 550

471 EGEIYDINLEEEEELQVLQPRNIAKRHDEGHKGPRDLQASSGGNRGRMLA 520
    ||||||||||||||||||||||||||||||||||||||||||||||||||
551 EGEIYDINLEEEEELQVLQPRNIAKRHDEGHKGPRDLQASSGGNRGRMLA 600

521 DSSNAVGPPTTVRVTHKCFILPNDSIHCERELYQSARAWKDHKAYIDKEI 570
    ||||||||||||||||||||||||||||||||||||||||||||||||||
601 DSSNAVGPPTTVRVTHKCFILPNDSIHCERELYQSARAWKDHKAYIDKEI 650

571 EALQDKIKNLREVRGHLKRRKPEECSCSKQSYYNKEKGVKKQEKLKSHLH 620
    ||||||||||||||||||||||||||||||||||||||||||||||||||
651 EALQDKIKNLREVRGHLKRRKPEECSCSKQSYYNKEKGVKKQEKLKSHLH 700

621 PFKEAAQEVDSKLQLFKENNRRRKKERKEKRRQRKGEECSLPGLTCFTHD 670
    ||||||||||||||||||||||||||||||||||||||||||||||||||
701 PFKEAAQEVDSKLQLFKENNRRRKKERKEKRRQRKGEECSLPGLTCFTHD 750

671 NNHWQTAPFWNLGSFCACTSSNNNTYWCLRTVNETHNFLFCEFATGFLEY 720
    ||||||||||||||||||||||||||||||||||||||||||||||||||
751 NNHWQTAPFWNLGSFCACTSSNNNTYWCLRTVNETHNFLFCEFATGFLEY 800

721 FDMNTDPYQLTNTVHTVERGILNQLHVQLMELRSCQGYKQCNPRPKNLDV 770
    ||||||||||||||||||||||||||||||||||||||||||||||||||
801 FDMNTDPYQLTNTVHTVERGILNQLHVQLMELRSCQGYKQCNPRPKNLDV 850

771 GNKDGGSYDLHRGQLWDGWEG                             791
    |||||||||||||||||||||
801 GNKDGGSYDLHRGQLWDGWEG                             871
```

Sequence name: /tmp/AVAZGWHuF0/RzHFOnHIsT: SUL1_HUMAN (SEQ ID NO:1419)

Sequence documentation:

Alignment of: Z21368_PEA_1_P15 (SEQ ID NO:1291) x SUL1_HUMAN (SEQ ID NO:1419)

Alignment segment 1/1:

| | |
|---|---|
| Quality: 4174.00 | Escore: 0 |
| Matching length: 416 | Total length: 416 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT 50
    |||||||||||||||||||||||||||||||||||||||||||||||||
  1 MKYSCCALVLAVLGTELLGSLCSTVRSPRFRGRIQQERKNIRPNIILVLT 50

51 DDQDVELGSLQVMNKTRKIMEHGGATFINAFVTTPMCCPSRSSMLTGKYV 100
    |||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRTAFFGKYLNEYNGS 150
    |||||||||||||||||||||||||||||||||||||||||||||||||
101 HNHNVYTNNENCSSPSWQAMHEPRTFAVYLNNTGYRTAFFGKYLNEYNGS 150

151 YIPPGWREWLGLIKNSRFYNYTVCRNGIKEKHGFDYAKDYFTDLITNESI 200
    |||||||||||||||||||||||||||||||||||||||||||||||||
151 YIPPGWREWLGLIKNSRFYNYTVCRNGIKEKHGFDYAKDYFTDLITNESI 200

201 NYFKMSKRMYPHRPVMMVISHAAPHGPEDSAPQFSKLYPNASQHITPSYN 250
    |||||||||||||||||||||||||||||||||||||||||||||||||
201 NYFKMSKRMYPHRPVMMVISHAAPHGPEDSAPQFSKLYPNASQHITPSYN 250

251 YAPNMDKHWIMQYTGPMLPIHMEFTNILQRKRLQTLMSVDDSVERLYNML 300
    |||||||||||||||||||||||||||||||||||||||||||||||||
251 YAPNMDKHWIMQYTGPMLPIHMEFTNILQRKRLQTLMSVDDSVERLYNML 300

301 VETGELENTYIIYTADHGYHIGQFGLVKGKSMPYDFDIRVPFFIRGPSVE 350
    |||||||||||||||||||||||||||||||||||||||||||||||||
301 VETGELENTYIIYTADHGYHIGQFGLVKGKSMPYDFDIRVPFFIRGPSVE 350

351 PGSIVPQIVLNIDLAPTILDIAGLDTPPDVDGKSVLKLLDPEKPGNRFRT 400
    |||||||||||||||||||||||||||||||||||||||||||||||||
351 PGSIVPQIVLNIDLAPTILDIAGLDTPPDVDGKSVLKLLDPEKPGNRFRT 400

401 NKKAKIWRDTFLVERG                                   416
    ||||||||||||||||
401 NKKAKIWRDTFLVERG                                   416
```

Sequence name: /tmp/JhwgRdKqmt/kqSmjxkWWk: SUL1_HUMAN (SEQ ID NO:1419)

Sequence documentation:

Alignment of: Z21368_PEA_1_P16 (SEQ ID NO:1292) x SUL1_HUMAN (SEQ ID NO:1419)

Alignment segment 1/1:

| Quality: 3985.00 | Escore: 0 |
|---|---|
| Matching length: 397 | Total length: 397 |

| Matching Percent Similarity: 100.00 | Matching Percent Identity: 100.00 |
|---|---|
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT 50
    |||||||||||||||||||||||||||||||||||||||||||||||||
  1 MKYSCCALVLAVLGTELLGSLCSTVRSPRFRGRIQQERKNIRPNIILVLT 50

51 DDQDVELGSLQVMNKTRKIMEHGGATFINAFVTTPMCCPSRSSMLTGKYV 100
    |||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRTAFFGKYLNEYNGS 150
    |||||||||||||||||||||||||||||||||||||||||||||||||
101 HNHNVYTNNENCSSPSWQAMHEPRTFAVYLNNTGYRTAFFGKYLNEYNGS 150

151 YIPPGWREWLGLIKNSRFYNYTVCRNGIKEKHGFDYAKDYFTDLITNESI 200
    |||||||||||||||||||||||||||||||||||||||||||||||||
151 YIPPGWREWLGLIKNSRFYNYTVCRNGIKEKHGFDYAKDYFTDLITNESI 200

201 NYFKMSKRMYPHRPVMMVISHAAPHGPEDSAPQFSKLYPNASQHITPSYN 250
    |||||||||||||||||||||||||||||||||||||||||||||||||
201 NYFKMSKRMYPHRPVMMVISHAAPHGPEDSAPQFSKLYPNASQHITPSYN 250
```

-continued

```
251 YAPNMDKHWIMQYTGPMLPIHMEFTNILQRKRLQTLMSVDDSVERLYNML 300
    ||||||||||||||||||||||||||||||||||||||||||||||||||
251 YAPNMDKHWIMQYTGPMLPIHMEFTNILQRKRLQTLMSVDDSVERLYNML 300

301 VETGELENTYIIYTADHGYHIGQFGLVKGKSMPYDFDIRVPFFIRGPSVE 350
    ||||||||||||||||||||||||||||||||||||||||||||||||||
301 VETGELENTYIIYTADHGYHIGQFGLVKGKSMPYDFDIRVPFFIRGPSVE 350

351 PGSIVPQIVLNIDLAPTILDIAGLDTPPDVDGKSVLKLLDPEKPGNR    397
    ||||||||||||||||||||||||||||||||||||||||||||||
351 PGSIVPQIVLNIDLAPTILDIAGLDTPPDVDGKSVLKLLDPEKPGNR    397
```

Sequence name: /tmp/GPlnIw3BOg/zXFdxqG4ow: SUL1_HUMAN (SEQ ID NO:1419)

Sequence documentation:

Alignment of: Z21368_PEA_1_P22 (SEQ ID NO:1293) x SUL1_HUMAN (SEQ ID NO:1419)

Alignment segment 1/1:

| | |
|---|---|
| Quality: 1897.00 | Escore: 0 |
| Matching length: 188 | Total length: 188 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT 50
    ||||||||||||||||||||||||||||||||||||||||||||||||||
  1 MKYSCCALVLAVLGTELLGSLCSTVRSPRFRGRIQQERKNIRPNIILVLT 50

51 DDQDVELGSLQVMNKTRKIMEHGGATFINAFVTTPMCCPSRSSMLTGKYV 100
    ||||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRTAFFGKYLNEYNGS 150
    ||||||||||||||||||||||||||||||||||||||||||||||||||
101 HNHNVYTNNENCSSPSWQAMHEPRTFAVYLNNTGYRTAFFGKYLNEYNGS 150

151 YIPPGWREWLGLIKNSRFYNYTVCRNGIKEKHGFDYAK              188
    |||||||||||||||||||||||||||||||||||||
151 YIPPGWREWLGLIKNSRFYNYTVCRNGIKEKHGFDYAK              188
```

Sequence name: /tmp/oji5Fs74fB/8xeB9KrGjp:Q7Z2W2 (SEQ ID NO:1697)

Sequence documentation:

Alignment of: Z21368_PEA_1_P23 (SEQ ID NO:1294) x Q7Z2W2 (SEQ ID NO:1697)

Alignment segment 1/1:

| | |
|---|---|
| Quality: 1368.00 | Escore: 0.000511 |
| Matching length: 137 | Total length: 137 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT 50
    ||||||||||||||||||||||||||||||||||||||||||||||||||
  1 MKYSCCALVLAVLGTELLGSLCSTVRSPRFRGRIQQERKNIRPNIILVLT 50
```

```
 51 DDQDVELGSLQVMNKTRKIMEHGGATFINAFVTTPMCCPSRSSMLTGKYV 100
    ||||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRT              137
    ||||||||||||||||||||||||||||||||||||
101 HNHNVYTNNENCSSPSWQAMHEPRTFAVYLNNTGYRT              137
```

Sequence name: /tmp/oji5Fs74fB/8xeB9KrGjp: SUL1_HUMAN (SEQ ID NO:1419)

Sequence documentation:

Alignment of: Z21368_PEA_1_P23 (SEQ ID NO:1294) x SUL1_HUMAN (SEQ ID NO:1419)

Alignment segment 1/1:

| | |
|---|---|
| Quality: 1368.00 | Escore: 0.000511 |
| Matching length: 137 | Total length: 137 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MKYSCCALVLAVLGTELLGSLCSTVRSPRFRGRIQQERKNIRPNIILVLT 50
    |||||||||||||||||||||||||||||||||||||||||||||||||
  1 MKYSCCALVLAVLGTELLGSLCSTVRSPRFRGRIQQERKNIRPNIILVLT 50

51 DDQDVELGSLQVMNKTRKIMEHGGATFINAFVTTPMCCPSRSSMLTGKYV 100
    ||||||||||||||||||||||||||||||||||||||||||||||||||
 51 DDQDVELGSLQVMNKTRKIMEHGGATFINAFVTTPMCCPSRSSMLTGKYV 100

101 HNHNVYTNNENCSSPSWQAMHEPRTFAVYLNNTGYRT              137
    ||||||||||||||||||||||||||||||||||||
101 HNHNVYTNNENCSSPSWQAMHEPRTFAVYLNNTGYRT              137
```

Expression of SUL1_HUMAN—Extracellular Sulfatase Sulf-1Z21368 Transcripts which are Detectable by Amplicon as Depicted in Sequence Name Z21368junc17-21 (SEQ ID NO:1642) in Normal and Cancerous Lung Tissues Expression of SUL1_HUMAN—Extracellular sulfatase Sulf-1 transcripts detectable by or according to junc17-21 segment, Z21368junc17-21 amplicon (SEQ ID NO:1642) and Z21368junc17-21F (SEQ ID NO:1640) Z21368junc17-21R (SEQ ID NO:1641) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table2, "Tissue samples in testing panel", above), to obtain a value of fold up-regulation for each sample relative to median of the normal PM samples.

Figure 14:
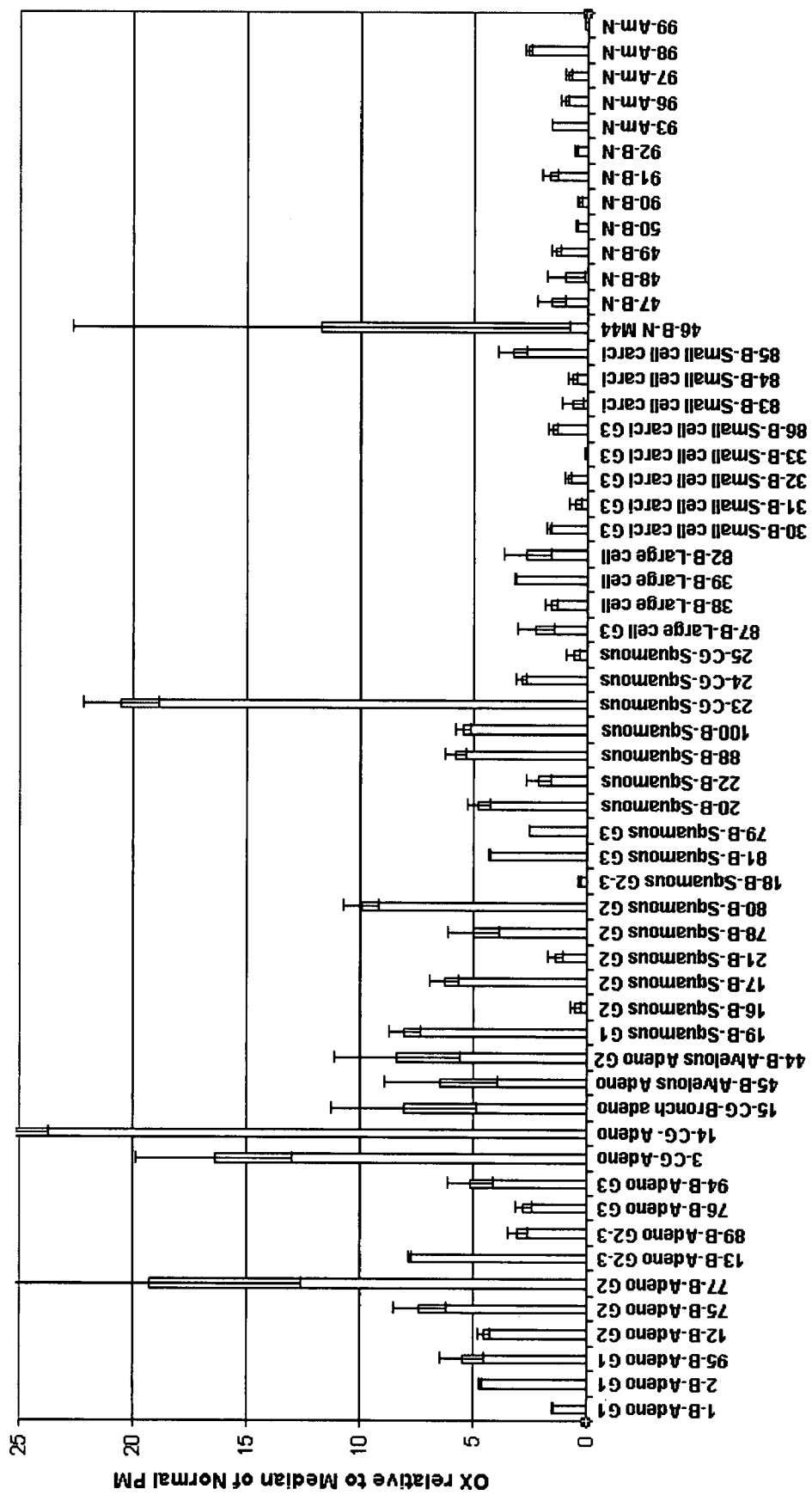
FIG. 14 is a histogram showing over expression of the Extracellular sulfatase Sulf-1 Z21368 transcripts, which are detectable by amplicon as depicted in sequence name Z21368junc17-21 (SEQ ID NO:1642), in cancerous lung samples relative to the normal samples.

FIG. 14 is a histogram showing over expression of the above-indicated SUL1_HUMAN—Extracellular sulfatase Sulf-1 transcripts in cancerous lung samples relative to the normal samples. Values represent the average of duplicate experiments. Error bars indicate the minimal and maximal values obtained. As is evident from FIG. 14, the expression of SUL1_HUMAN—Extracellular sulfatase Sulf-1 transcripts detectable by the above amplicon in cancer samples was significantly higher than in the non-cancerous samples (Sample Nos. 47-50, 90-93, 96-99 Table 2, "Tissue samples in testing panel"). Notably an over-expression of at least 5 fold was found in 10 out of 15 adenocarcinoma samples, 7 out of 16 squamous cell carcinoma samples, 0 out of 4 large cell carcinoma samples and in 0 out of 8 small cells carcinoma samples.

Threshold of 5 fold over-expression was found to differentiate between cancer and normal samples with P value of 3.56E-04 in adenocarcinoma, 9.66E-03 in squamous cell carcinomas checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z21368junc17-21F forward primer (SEQ ID NO:1640); and Z21368junc17-21 R reverse primer (SEQ ID NO:1641).

The present invention also preferably encompasses any amplicon obtained through the use of any suitable primer pair; for example, for the above experiment, the following amplicon was obtained as a non-limiting illustrative example only of a suitable amplicon: Z21368junc17-21 (SEQ ID NO:1642).

Forward primer (SEQ ID NO: 1640): GGACGGATACAGCAGGAACG

Reverse amplicon (SEQ ID NO: 1641): TATTTTCCAAAAAAGGCCAGCTC

Amplicon (SEQ ID NO: 1642): GGACGGATACAGCAG-GAACGAAAAAACATCCGACCCAACAT-TATTCTTGTGCTTACCGATGATCAAGATGTG GAGCTGGCCTTTTTTGGAAAATA Expression of SUL1_HUMAN—Extracellular Sulfatase Sulf-1Z21368 Transcripts, which are Detectable by Amplicon as Depicted in Sequence Name Z21368 junc17-21 (SEQ ID NO:1642) in Different Normal Tissues Expression of SUL1_HUMAN—Extracellular sulfatase Sulf-1 transcripts detectable by or according to Z21368 junc17-21 amplicon (SEQ ID NO:1642) and Z21368 junc17-21F (SEQ ID NO:1640) and Z21368 junc17-21R (SEQ ID NO:1641) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 Table 3, "Tissue samples in normal panel", above), to obtain a value of relative expression of each sample relative to median of the breast samples.

Forward primer (SEQ ID NO: 1640): GGACGGATACAG-CAGGAACG

Reverse amplicon (SEQ ID NO: 1641): TATTTTC-CAAAAAAGGCCAGCTC

Figure 15:
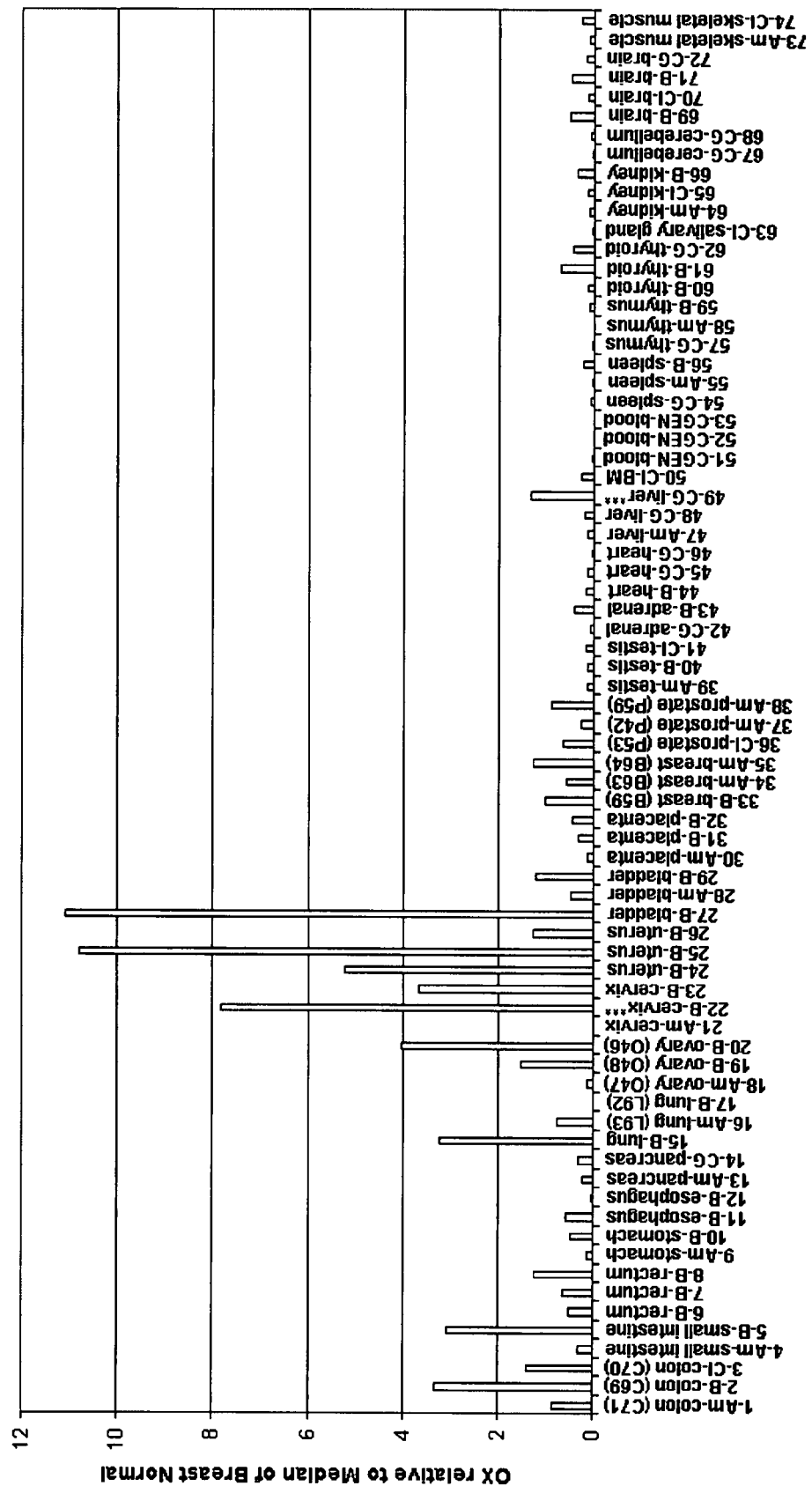
FIG. 15 is a histogram showing the expression of Extracellular sulfatase Sulf-1 Z21368 transcripts, which are detectable by amplicon as depicted in sequence name Z21368junc17-21 (SEQ ID NO:1642), in different normal tissues.

Amplicon (SEQ ID NO: 1642): GGACGGATACAGCAG-GAACGAAAAAACATCCGACCCAACAT-TATTCTTGTGCTTACCGATGATCAAGATGTG GAGCTGGCCTTTTTTGGAAAATA The results are shown in FIG. 15, demonstrating the expression of Extracellular sulfatase Sulf-1Z21368 transcripts, which are detectable by amplicon as depicted in sequence name Z21368 junc17-21 (SEQ ID NO:1642), in different normal tissues.

Expression of SUL1_HUMAN—Extracellular Sulfatase Sulf-1Z21368 Transcripts which are Detectable by Amplicon as Depicted in Sequence Name Z21368seg39 (SEQ ID NO:1645) in Normal and Cancerous Lung Tissues Expression of SUL1_HUMAN—Extracellular sulfatase Sulf-1 transcripts detectable by or according to seg39, Z21368seg39 amplicon (SEQ ID NO:1645) and primers Z21368seg39F (SEQ ID NO:1643) and Z21368seg39R (SEQ ID NO:1644) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel"), to obtain a value of fold up-regulation for each sample relative to median of the normal PM samples.

Figure 16:
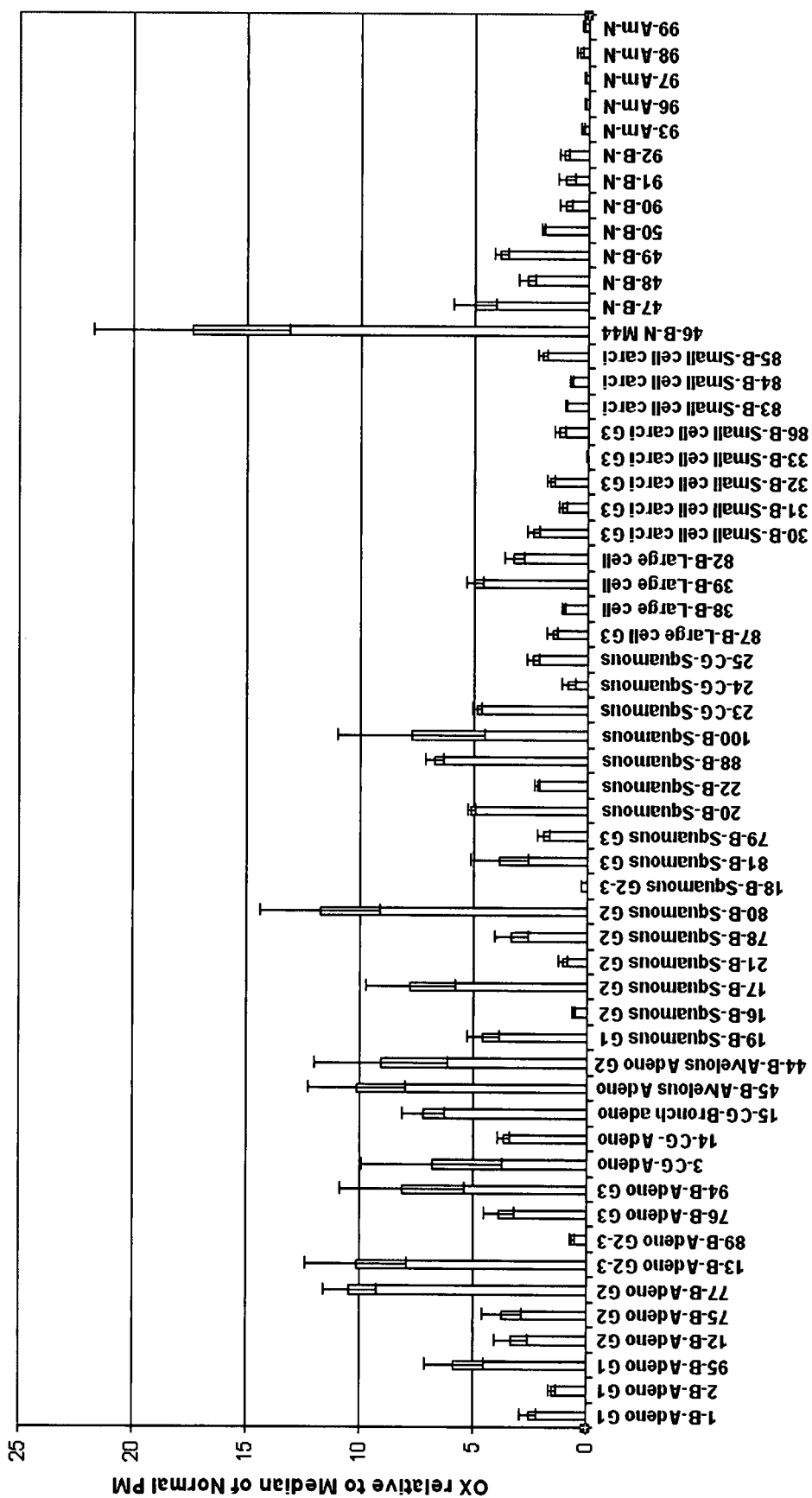
FIG. 16 is a histogram showing over expression of the SUL1_HUMAN—Extracellular sulfatase Sulf-1, Z21368 transcripts, which are detectable by amplicon as depicted in sequence name Z21368seg39 (SEQ ID NO: 1645), in cancerous lung samples relative to the normal samples.

FIG. 16 is a histogram showing over expression of the above-indicated SUL1_HUMAN—Extracellular sulfatase Sulf-1 transcripts in cancerous lung samples relative to the normal samples. Values represent the average of duplicate experiments. Error bars indicate the minimal and maximal values obtained.

As is evident from FIG. 16, the expression of SUL1_HUMAN—Extracellular sulfatase Sulf-1 transcripts detectable by the above amplicon in cancer samples was higher than in the non-cancerous samples (Sample Nos. 47-50, 90-93, 96-99 Table 2, "Tissue samples in testing panel"). Notably an over-expression of at least 5 fold was found in 8 out of 15 adenocarcinoma samples, 5 out of 16 squamous cell carcinoma samples and 1 out of 4 large cell carcinoma samples.

Statistical analysis was applied to verify the significance of these results, as described below.

The P value for the difference in the expression levels of SUL1_HUMAN—Extracellular sulfatase Sulf-1 transcripts detectable by the above amplicon in lung cancer samples versus the normal tissue samples was determined by T test as 2.17E-04 in adenocarcinoma, 9.94E-03 in squamous cell carcinoma and 2.17E-01 in large cell carcinoma.

Threshold of 5 fold overexpression was found to differentiate between cancer and normal samples with P value of 1.74E-02 in adenocarcinoma, 1.58E-01 in squamous cell carcinoma and 4.33E-01 in large cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z21368seg39F forward primer (SEQ ID NO:1643); and Z21368seg39R reverse primer (SEQ ID NO:1644).

The present invention also preferably encompasses any amplicon obtained through the use of any suitable primer pair; for example, for the above experiment, the following amplicon was obtained as a non-limiting illustrative example only of a suitable amplicon: Z21368seg39 (SEQ ID NO:1645).

Forward primer Z21368seg39F (SEQ ID NO:1643): GTTG-CATTTCTCAGTGCTGGTTT

Reverse primer Z21368seg39R (SEQ ID NO:1644): AGGGTGCCGGGTGAGG

Amplicon Z21368seg39 (SEQ ID NO:1645): GTTG-CATTTCTCAGTGCTGGTTTCTAATCA-GACCAGTGGATTGAGTTTCTCTACCATC-CTCCCCACGTTCTTCTC TAAGCTGCCTCCAAGCCTCACCCGGCACCCT Expression of SUL1_HUMAN—Extracellular Sulfatase Sulf-1Z21368 Transcripts which are Detectable by Amplicon as Depicted in Sequence Name Z21368seg39 (SEQ ID NO:1645) in Different Normal Tissues Expression of SUL1_HUMAN—Extracellular sulfatase Sulf-1 transcripts detectable by or according to Z21368seg39 amplicon (SEQ ID NO: 1645) and Z21368seg39F (SEQ ID NO: 1643) Z21368seg39R (SEQ ID NO: 1644) was measured by real time PCR. In parallel the expression of four housekeeping genes—[RPL19 (GenBank Accession No.

NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35 Table 3, above), to obtain a value of relative expression of each sample relative to median of the breast samples.

Forward primer Z21368seg39F (SEQ ID NO: 1643): GTTGCATTTCTCAGTGCTGGTTT

Reverse primer Z21368seg39R (SEQ ID NO: 1644): AGGGTGCCGGGTGAGG

Figure 17:
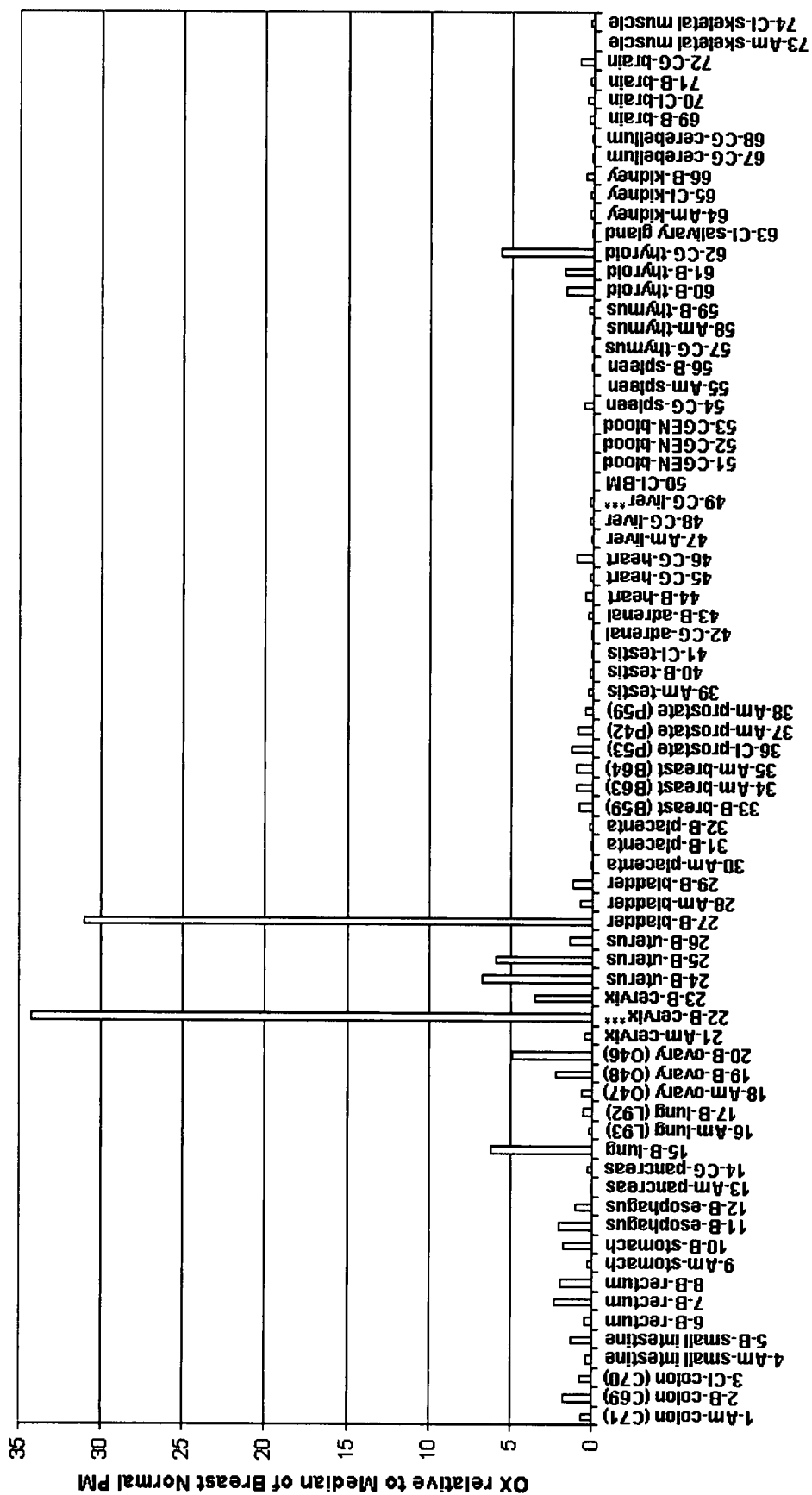
FIG. 17 is a histogram showing expression of SUL1_HUMAN—Extracellular sulfatase Sulf-1, Z21368 transcripts, which are detectable by amplicon as depicted in sequence name Z21368seg39 (SEQ ID NO:1645), in different normal tissues.

Amplicon Z21368seg39 (SEQ ID NO: 1645): GTTGCATTTCTCAGTGCTGGTTTCTAATCAGACCAGTGGATTGAGTTTCTCTACCATCCTCCCCACGTTCTTCTCTAAGCTGCCTCCAAGCCTCACCCGGCACCCT The results are demonstrated in FIG. 17, showing expression of SUL1_HUMAN—Extracellular sulfatase Sulf-1, Z21368 transcripts, which are detectable by amplicon as depicted in sequence name Z21368seg39 (SEQ ID NO: 1645), in different normal tissues.

Expression of SULF1 Z21368 Transcripts which are Delectable by Amplicon as Depicted in Sequence Name Z21368_junc59-64F1R1 (SEQ ID NO:1801) in Normal and Cancerous Lung Tissues Expression of SULF1 transcripts detectable by or according to junc59-64—Z21368_junc59-64F1R1 (SEQ ID NO: 1801) amplicon (SEQ ID NO: 1801) and primers Z21368_junc59-64F1 (SEQ ID NO: 1799) and Z21368_junc59-64R1 (SEQ ID NO: 1800) was measured by real time PCR. In parallel the expression of several housekeeping genes—HPRT1 (GenBank Accession No. NM_000194 (SEQ ID NO: 1714); amplicon—HPRT1-amplicon (SEQ ID NO: 1297)), PBGD (GenBank Accession No. BC019323 (SEQ ID NO: 1713); amplicon—PBGD-amplicon (SEQ ID NO: 334)), SDHA (GenBank Accession No. NM_004168 (SEQ ID NO: 1712); amplicon—SDHA-amplicon (SEQ ID NO: 331)) and Ubiquitin (GenBank Accession No. BC000449 (SEQ ID NO: 1711); amplicon—Ubiquitin-amplicon (SEQ ID NO: 328)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the normal samples (sample numbers 51-64, 69 and 70, Table 2_1 above), to obtain a value of fold up-regulation for each sample relative to median of the normal samples.

Figure 114:
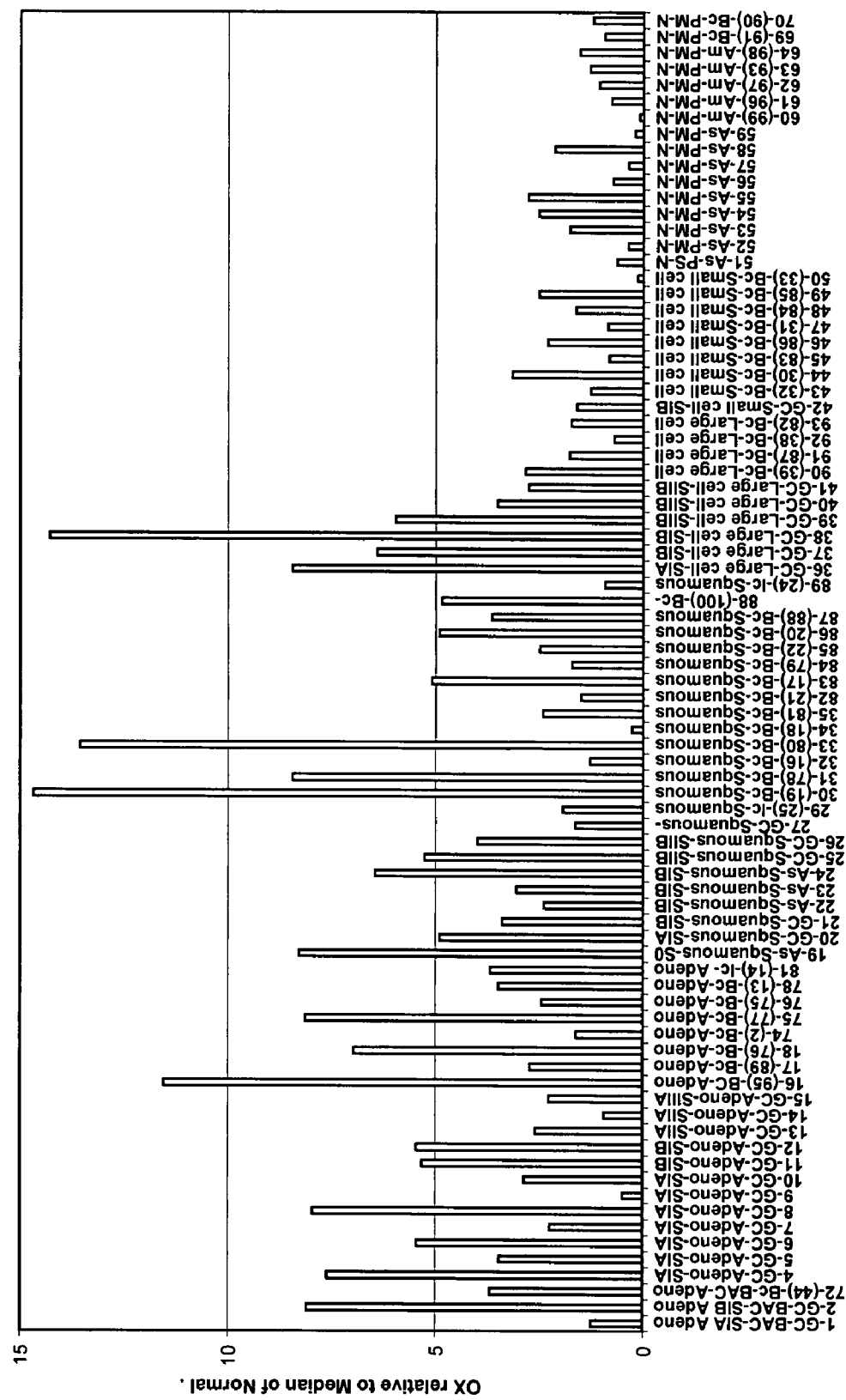
FIG. 114 is a histogram showing the expression of SULF1 Z21368 transcripts which are detectable by amplicon as depicted in sequence name Z21368_junc59-64F1R1 (SEQ ID NO: 1801) in normal and cancerous Lung tissues.

FIG. 114 is a histogram showing over expression of the above-indicated SULF1 transcripts in cancerous Lung samples relative to the normal samples.

As is evident from FIG. 114, the expression of SULF1 transcripts detectable by the above amplicon in non-small cell carcinoma samples—adenocarcinoma, squamous cell carcinoma and large cell carcinoma was significantly higher than in the non-cancerous samples (sample numbers 51-64, 69 and 70, Table 2_1 above). Notably an over-expression of at least 5 fold was found in 20 out of 57 non-small cell carcinoma samples-9 out of 23 adenocarcinoma samples, 7 out of 24 squamous cell carcinoma samples and 4 out of 10 large cell carcinoma samples.

Statistical analysis was applied to verify the significance of these results, as described below.

The P value for the difference in the expression levels of SULF1 transcripts detectable by the above amplicon in Lung non-small cell carcinoma samples versus the normal tissue samples was determined by T test as 1.60e-009. The P value for the difference in the expression levels of SULF1 transcripts detectable by the above amplicon in Lung adenocarcinoma samples, Lung squamous cell carcinoma samples and Lung large cell carcinoma samples versus the normal tissue samples was determined by T test as 1.18e-005, 1.16e-004 and 9.83e-003, respectively.

Threshold of 5 fold over expression was found to differentiate between non-small cell carcinoma and normal samples with P value of 2.82e-003 as checked by exact Fisher test. Threshold of 5 fold over expression was found to differentiate between adenocarcinoma and normal samples with P value of 3.86e-003 as checked by exact Fisher test.

Threshold of 5 fold over expression was found to differentiate between squamous cell carcinoma and normal samples with value of 1.86e-002 as checked by exact Fisher test. Threshold of 5 fold over expression was found to differentiate between large cell carcinoma and normal samples with P value of 1.40e-002 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: Z21368_junc59-64F1 forward primer (SEQ ID NO: 1799); and Z21368_junc59-64R1 reverse primer (SEQ ID NO: 1800).

The present invention also preferably encompasses any amplicon obtained through the use of any suitable primer pair; for example, for the above experiment, the following amplicon was obtained as a non-limiting illustrative example only of a suitable amplicon: Z21368_junc59-64F1R1 (SEQ ID NO:1801).

Forward Primer (Z21368_junc59-64F1) (SEQ ID NO:1799): AACAACCGTAGGAGGAAGAAGGA

Reverse Primer (Z21368_junc59-64R1) (SEQ ID NO:1800): GTGTGCACTGTATTTGTGAGGGTTC

Amplicon (Z21368_junc59-64F1R1) (SEQ ID NO:1801): AACAACCGTAGGAGGAAGAAGGAGAGGAAGGAGAAGAGACGGCAGAGGAAGGGGGAAGAGTGCAGCCTGCCTGGCCTCACTTGCTTCACGCATGACAACAACCACTGGCAGACAGCCCCGTTCTGGAACCCTCACAAATACAGTGCACAC Expression of SULF1 Z21368 Transcripts which are Detectable by Amplicon as Depicted in Sequence Name Z21368_junc59-64F1R1 (SEQ ID NO:1801) in Different Normal Tissues Expression of SULF1 transcripts detectable by or according to junc59-64-Z21368_junc59-64F1R1 amplicon (SEQ ID NO: 1801) and primers Z21368_junc59-64F1 (SEQ ID NO: 1799) and Z21368_junc59-64R1 (SEQ ID NO: 1800) was measured by real time PCR. Non-detected samples (sample no. 51) were assigned Ct value of 41 and were calculated accordingly. In parallel the expression of several housekeeping genes—SDHA (GenBank Accession No. NM_004168 (SEQ ID NO: 1712); amplicon—SDHA-amplicon (SEQ ID NO: 331)), Ubiquitin (GenBank Accession No. BC000449 (SEQ ID NO: 1711); amplicon—Ubiquitin-amplicon (SEQ ID NO: 328)), RPL19 (GenBank Accession No. NM_000981 (SEQ ID NO: 1715); RPL19 amplicon (SEQ ID NO: 1630)) and TATA box (GenBank Accession No. NM_003194 (SEQ ID NO: 1716); TATA amplicon (SEQ ID NO: 1633)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the lung samples (sample numbers 26, 28, 29 and 30, Table 3_1 above), to obtain a value of relative expression of each sample relative to median of the lung samples.

Forward Primer (Z21368_junc59-64F1) (SEQ ID NO:1799): AACAACCGTAGGAGGAAGAAGGA

Reverse Primer (Z21368_junc59-64R1) (SEQ ID NO:1800): GTGTGCACTGTATTTGTGAGGGTTC

Figure 115:
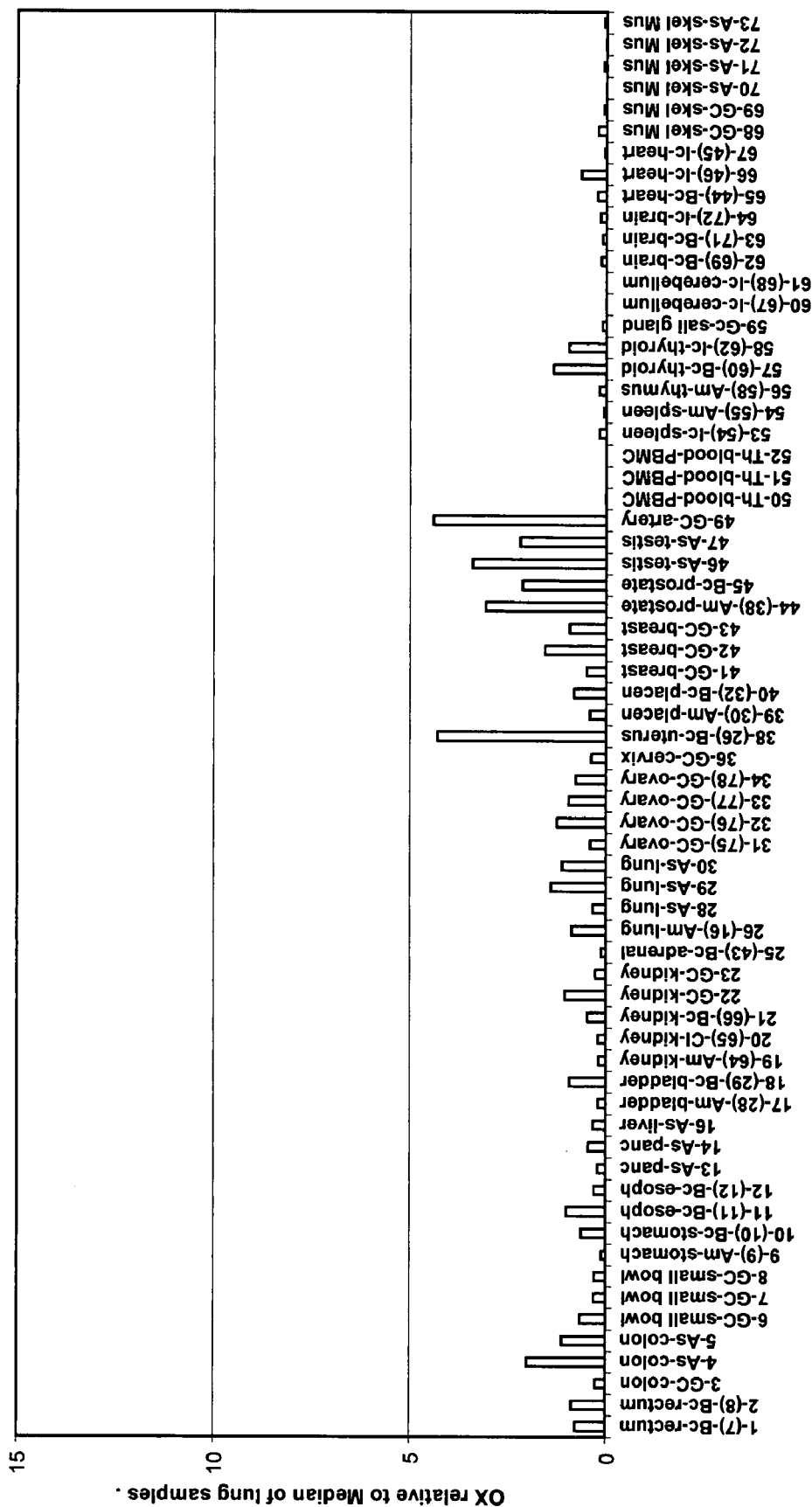
FIG. 115 is a histogram showing the expression of SULF1 Z21368 transcripts which are detectable by amplicon as depicted in sequence name Z21368_junc59-64F1R1 (SEQ ID NO: 1801) in different normal tissues.

Amplicon (Z21368_junc59-64F1R1) (SEQ ID NO:1801): AACAACCGTAGGAGGAAGAAGGAGAG-GAAGGAGAAGAGACGGCAGAGGAAGGGG-GAAGAGTGCAGCCTGCCTGGCCTCACTTG CTTCACGCATGACAACAACCACTGGCA-GACAGCCCCGTTCTGGAACCCTCA-CAAATACAGTGCACAC FIG. 115 is a histogram showing the expression of SULF1 Z21368 transcripts which are detectable by amplicon as depicted in sequence name Z21368_junc59-64F1R1 (SEQ ID NO:1801) in different normal tissues.

Description for Cluster HUMGRP5E

Cluster HUMGRP5E features 2 transcript(s) and 5 segment(s) of interest, the names for which are given in Tables 122 and 123, respectively, the sequences themselves are given at the end of the application. The selected protein variants are given in table 124.

TABLE 122

Transcripts of interest

| Transcript Name | Sequence ID No. |
|---|---|
| HUMGRP5E_T4 | 20 |
| HUMGRP5E_T5 | 21 |

TABLE 123

Segments of interest

| Segment Name | Sequence ID No. |
|---|---|
| HUMGRP5E_node_0 | 335 |
| HUMGRP5E_node_2 | 336 |
| HUMGRP5E_node_8 | 337 |
| HUMGRP5E_node_3 | 338 |
| HUMGRP5E_node_7 | 339 |

TABLE 124

Proteins of interest

| Protein Name | Sequence ID No. |
|---|---|
| HUMGRP5E_P4 | 1299 |
| HUMGRP5E_P5 | 1300 |

These sequences are variants of the known protein Gastrin-releasing peptide precursor (SwissProt accession identifier GRP_HUMAN; known also according to the synonyms GRP; GRP-10), SEQ ID NO:1421, referred to herein as the previously known protein. Known isoforms of the GRP protein are described in sp_vs|P07492-2|GRP_HUMAN Isoform 2 (SEQ ID NO:1788) and sp_vs|P07492-3|GRP_HUMAN Isoform 3 (SEQ ID NO:1789).

Gastrin-releasing peptide is known or believed to have the following function(s): stimulates gastrin release as well as other gastrointestinal hormones. The sequence for protein Gastrin-releasing peptide precursor (SEQ ID NO:1421) is given at the end of the application, as "Gastrin-releasing peptide precursor amino acid sequence". Known polymorphisms for this sequence are as shown in Table 125.

TABLE 125

Amino acid mutations for Known Protein

| SNP position(s) on amino acid sequence | Comment |
|---|---|
| 4 | S -> R |

Protein Gastrin-releasing peptide localization is believed to be Secreted.

The previously known protein also has the following indication(s) and/or potential therapeutic use(s): Diabetes, Type II. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bombesin antagonist; Insulinotropin agonist. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anorectic/Antiobesity; Releasing hormone; Anticancer; Respiratory; Antidiabetic.

The following GO Annotation(s) apply to the previously known protein. The following annotation(s) were found: signal transduction; neuropeptide signaling pathway, which are annotation(s) related to Biological Process; growth factor, which are annotation(s) related to Molecular Function; and secreted, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster HUMGRP5E features 2 transcript(s), which were listed in Table 122 above. These transcript(s) encode for protein(s) which are variant(s) of protein Gastrin-releasing peptide precursor (SEQ ID NO:1421). A description of each variant protein according to the present invention is now provided.

Variant protein HUMGRP5E_P4 (SEQ ID NO:1299) according to the present invention has an amino acid sequence as given at the end of the application; it is encoded by transcript(s) HUMGRP5E_T4 (SEQ ID NO:20). An alignment is given to the known protein (Gastrin-releasing peptide precursor (SEQ ID NO:1421)) at the end of the application. One or more alignments to one or more previously published protein sequences are given at the end of the application. A brief description of the relationship of the variant protein according to the present invention to each such aligned protein is as follows:

Comparison report between HUMGRP5E_P4 (SEQ ID NO:1299) and GRP_HUMAN (SEQ ID NO:1421):

1. An isolated chimeric polypeptide encoding for HUMGRP5E_P4 (SEQ ID NO:1299), comprising a first amino acid sequence being at least 90% homologous to MRGSELPLVLLALVLCLAPRGRAV-PLPAGGGTVLTKMYPRGNH-WAVGHLMGKKSTGESSSVSERGSLKQQLREY IRWEEAARNLLGLIEAKENRNHQPPQP-KALGNQQPSWDSEDSSNFKDVGSKGK corresponding to amino acids 1-127 of GRP_HUMAN (SEQ ID NO:1421), which also corresponds to amino acids 1-127 of HUMGRP5E_P4 (SEQ ID NO:1299), and a second amino acid sequence being at least 90% homologous to GSQRE-GRNPQLNQQ corresponding to amino acids 135-148 of GRP_HUMAN (SEQ ID NO:1421), which also corresponds to amino acids 128-141 of HUMGRP5E_P4 (SEQ ID NO:1299), wherein said first and second amino acid sequences are contiguous and in a sequential order.

2. An isolated chimeric polypeptide encoding for an edge portion of HUMGRP5E_P4 (SEQ ID NO:1299), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KG, having a structure as follows: a sequence starting from any of amino acid numbers 127-x to 127; and ending at any of amino acid numbers 128+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P4 (SEQ ID NO:1299) also has the following non-silent SNPs (Single Nucleotide Polymorphisms) as listed in Table 126, (given according to their position(s) on the amino acid sequence, with the alternative amino acid(s) listed; the last column indicates whether the SNP is known or not; the presence of known SNPs in variant protein HUMGRP5E_P4 (SEQ ID NO:1299) sequence provides support for the deduced sequence of this variant protein according to the present invention).

TABLE 126

Amino acid mutations

| SNP position(s) on amino acid sequence | Alternative amino acid(s) | Previously known SNP? |
| --- | --- | --- |
| 4 | S -> R | Yes |

Variant protein HUMGRP5E_P4 (SEQ ID NO:1299) is encoded by the following transcript(s): HUMGRP5E_T4 (SEQ ID NO:20), for which the sequence(s) is/are given at the end of the application. The coding portion of transcript HUMGRP5E_T4 (SEQ ID NO:20) is shown in bold; this coding portion starts at position 622 and ends at position 1044. The transcript also has the following SNPs as listed in Table 127 (given according to their position on the nucleotide sequence, with the alternative nucleic acid listed; the last column indicates whether the SNP is known or not; the presence of known SNPs in variant protein HUMGRP5E_P4 (SEQ ID NO:1299) sequence provides support for the deduced sequence of this variant protein according to the present invention).

TABLE 127

Nucleic acid SNPs

| SNP position(s) on nucleotide sequence | Alternative nucleic acid | Previously known SNP? |
| --- | --- | --- |
| 541 | -> T | No |
| 542 | G -> T | No |
| 631 | A -> C | Yes |
| 672 | G -> A | Yes |
| 1340 | C -> | No |
| 1340 | C -> A | No |
| 1341 | A -> | No |
| 1341 | A -> G | No |

Variant protein HUMGRP5E_P5 (SEQ ID NO:1300) according to the present invention has an amino acid sequence as given at the end of the application; it is encoded by transcript(s) HUMGRP5E_T5 (SEQ ID NO:21). An alignment is given to the known protein (Gastrin-releasing peptide precursor (SEQ ID NO:1421)) at the end of the application. One or more alignments to one or more previously published protein sequences are given at the end of the application. A brief description of the relationship of the variant protein according to the present invention to each such aligned protein is as follows:

Comparison report between HUMGRP5E_P5 (SEQ ID NO:1300) and GRP_HUMAN (SEQ ID NO:1421):

1. An isolated chimeric polypeptide encoding for HUMGRP5E_P5 (SEQ ID NO:1300), comprising a first amino acid sequence being at least 90% homologous to MRGSELPLVLLALVLCLAPRGRAV-PLPAGGGTVLTKMYPRGNH-WAVGHLMGKKSTGESSSVSERGSLKQQLREY IRWEEAARNLLGLIEAKENRNHQPPQP-KALGNQQPSWDSEDSSNFKDVGSKGK corresponding to amino acids 1-127 of GRP_HUMAN (SEQ ID NO:1421), which also corresponds to amino acids 1-127 of HUMGRP5E_P5 (SEQ ID NO:1300), and a second amino acid sequence being at least 70%, optionally at least 80%, preferably at least 85%, more preferably at least 90% and most preferably at least 95% homologous to a polypeptide having the sequence DSLLQVLNVKEGTPS (SEQ ID NO:1764) corresponding to amino acids 128-142 of HUMGRP5E_P5 (SEQ ID NO:1300), wherein said first and second amino acid sequences are contiguous and in a sequential order.

2. An isolated polypeptide encoding for a tail of HUMGRP5E_P5 (SEQ ID NO:1300), comprising a polypeptide being at least 70%, optionally at least about 80%, preferably at least about 85%, more preferably at least about 90% and most preferably at least about 95% homologous to the sequence DSLLQVLNVKEGTPS (SEQ ID NO:1764) in HUMGRP5E_P5 (SEQ ID NO:1300).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMGRP5E_P5 (SEQ ID NO:1300) also has the following non-silent SNPs (Single Nucleotide Polymorphisms) as listed in Table 128, (given according to their position(s) on the amino acid sequence, with the alternative amino acid(s) listed; the last column indicates whether the SNP is known or not; the presence of known SNPs in variant protein HUMGRP5E_P5 (SEQ ID NO:1300) sequence provides support for the deduced sequence of this variant protein according to the present invention).

TABLE 128

Amino acid mutations

| SNP position(s) on amino acid sequence | Alternative amino acid(s) | Previously known SNP? |
|---|---|---|
| 4 | S -> R | Yes |

Variant protein HUMGRP5E_P5 (SEQ ID NO:1300) is encoded by the following transcript(s): HUMGRP5E_T5 (SEQ ID NO:21), for which the sequence(s) is/are given at the end of the application. The coding portion of transcript HUMGRP5E_T5 (SEQ ID NO:21) is shown in bold; this coding portion starts at position 622 and ends at position 1047. The transcript also has the following SNPs as listed in Table 129 (given according to their position on the nucleotide sequence, with the alternative nucleic acid listed; the last column indicates whether the SNP is known or not; the presence of known SNPs in variant protein HUMGRP5E_P5 (SEQ ID NO:1300) sequence provides support for the deduced sequence of this variant protein according to the present invention).

TABLE 129

Nucleic acid SNPs

| SNP position(s) on nucleotide sequence | Alternative nucleic acid | Previously known SNP? |
|---|---|---|
| 541 | -> T | No |
| 542 | G -> T | No |
| 631 | A -> C | Yes |
| 672 | G -> A | Yes |
| 1354 | C -> | No |
| 1354 | C -> A | No |
| 1355 | A -> | No |
| 1355 | A -> G | No |

As noted above, cluster HUMGRP5E features 5 segment(s), which were listed in Table 123 above and for which the sequence(s) are given at the end of the application. These segment(s) are portions of nucleic acid sequence(s) which are described herein separately because they are of particular interest. A description of each segment according to the present invention is now provided.

Segment cluster HUMGRP5E_node_0 (SEQ ID NO:1130) according to the present invention is supported by 21 libraries. The number of libraries was determined as previously described. This segment can be found in the following transcript(s): HUMGRP5E_T4 (SEQ ID NO:20) and HUMGRP5E_T5 (SEQ ID NO:21). Table 130 below describes the starting and ending position of this segment on each transcript.

TABLE 130

Segment location on transcripts

| Transcript name | Segment starting position | Segment ending position |
|---|---|---|
| HUMGRP5E_T4 (SEQ ID NO:20) | 1 | 760 |
| HUMGRP5E_T5 (SEQ ID NO:21) | 1 | 760 |

Segment cluster HUMGRP5E_node_2 (SEQ ID NO:1131) according to the present invention is supported by 27 libraries. The number of libraries was determined as previously described. This segment can be found in the following transcript(s): HUMGRP5E_T4 (SEQ ID NO:20) and HUMGRP5E_T5 (SEQ ID NO:21). Table 131 below describes the starting and ending position of this segment on each transcript.

TABLE 131

Segment location on transcripts

| Transcript name | Segment starting position | Segment ending position |
|---|---|---|
| HUMGRP5E_T4 (SEQ ID NO:20) | 761 | 984 |
| HUMGRP5E_T5 (SEQ ID NO:21) | 761 | 984 |

Segment cluster HUMGRP5E_node_8 (SEQ ID NO:1132) according to the present invention is supported by 26 libraries. The number of libraries was determined as previously described. This segment can be found in the following transcript(s): HUMGRP5E_T4 (SEQ ID NO:20) and HUMGRP5E_T5 (SEQ ID NO:21). Table 132 below describes the starting and ending position of this segment on each transcript.

TABLE 132

Segment location on transcripts

| Transcript name | Segment starting position | Segment ending position |
|---|---|---|
| HUMGRP5E_T4 (SEQ ID NO:20) | 1004 | 1362 |
| HUMGRP5E_T5 (SEQ ID NO:21) | 1018 | 1376 |

According to an optional embodiment of the present invention, short segments related to the above cluster are also provided. These segments are up to about 120 bp in length, and so are included in a separate description.

Segment cluster HUMGRP5E node_3 (SEQ ID NO:1133) according to the present invention can be found in the following transcript(s): HUMGRP5E_T4 (SEQ ID NO:20) and HUMGRP5E_T5 (SEQ ID NO:21). Table 133 below describes the starting and ending position of this segment on each transcript.

TABLE 133

Segment location on transcripts

| Transcript name | Segment starting position | Segment ending position |
|---|---|---|
| HUMGRP5E_T4 (SEQ ID NO:20) | 985 | 1003 |
| HUMGRP5E_T5 (SEQ ID NO:21) | 985 | 1003 |

Segment cluster HUMGRP5E_node_7 (SEQ ID NO:1134) according to the present invention can be found in the following transcript(s): HUMGRP5E_T5 (SEQ ID NO:21). Table 134 below describes the starting and ending position of this segment on each transcript.

TABLE 134

Segment location on transcripts

| Transcript name | Segment starting position | Segment ending position |
|---|---|---|
| HUMGRP5E_T5 (SEQ ID NO:21) | 1004 | 1017 |

Microarray (chip) data is also available for this gene as follows. As described above with regard to the cluster itself, various oligonucleotides were tested for being differentially expressed in various disease conditions, particularly cancer.

The following oligonucleotides were found to hit this segment (with regard to lung cancer), shown in Table 135.

TABLE 135

Oligonucleotides related to this gene

| Oligonucleotide name | Overexpressed in cancer | Chip reference |
|---|---|---|
| HUMGRP5E_0_0_16630 (SEQ ID NO: 208) | Lung cancer | Lung |
| HUMGRP5E_0_2_0 (SEQ ID NO: 209) | Lung cancer | Lung |

Variant protein alignment to the previously known protein:

Sequence name: /tmp/412zs2 mwyT/B0wjOUAX0d:GRP_HUMAN (SEQ ID NO:1421)

Sequence documentation:

Alignment of: HUMGRP5E_P4 (SEQ ID NO:1299) x GRP_HUMAN (SEQ ID NO:1421)

Alignment segment 1/1:

| Quality: 1291.00 | Escore: 0 |
|---|---|
| Matching length: 141 | Total length: 148 |
| Matching Percent Similarity: 100.00 | Matching Percent Identity: 100.00 |
| Total Percent Similarity: 95.27 | Total Percent Identity: 95.27 |
| Gaps: 1 | |

Alignment:

```
  1 MRGSELPLVLLALVLCLAPRGRAVPLPAGGGTVLTKMYPRGNHWAVGHLM  50
    ||||||||||||||||||||||||||||||||||||||||||||||||||
  1 MRGSELPLVLLALVLCLAPRGRAVPLPAGGGTVLTKMYPRGNHWAVGHLM  50

51 GKKSTGESSSVSERGSLKQQLREYIRWEEAARNLLGLIEAKENRNHQPPQ 100
    ||||||||||||||||||||||||||||||||||||||||||||||||||
 51 GKKSTGESSSVSERGSLKQQLREYIRWEEAARNLLGLIEAKENRNHQPPQ 100

101 PKALGNQQPSWDSEDSSNFKDVGSKGK.......GSQREGRNPQLNQQ   141
    |||||||||||||||||||||||||||       |||||||||||||||
101 PKALGNQQPSWDSEDSSNFKDVGSKGKVGRLSAPGSQREGRNPQLNQQ   148
```

Sequence name: /tmp/1me9ldnvfv/KbP5io8PtU:GRP_HUMAN (SEQ ID NO:1421)

Sequence documentation:

Alignment of: HUMGRP5E_P5 (SEQ ID NO:1300) x GRP_HUMAN (SEQ ID NO:1421)

Alignment segment 1/1:

| Quality: 1248.00 | Escore: 0 |
|---|---|
| Matching length: 127 | Total length: 127 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MRGSELPLVLLALVLCLAPRGRAVPLPAGGGTVLTKMYPRGNHWAVGHLM  50
    ||||||||||||||||||||||||||||||||||||||||||||||||||
  1 MRGSELPLVLLALVLCLAPRGRAVPLPAGGGTVLTKMYPRGNHWAVGHLM  50

51 GKKSTGESSSVSERGSLKQQLREYIRWEEAARNLLGLIEAKENRNHQPPQ 100
    ||||||||||||||||||||||||||||||||||||||||||||||||||
 51 GKKSTGESSSVSERGSLKQQLREYIRWEEAARNLLGLIEAKENRNHQPPQ 100

101 PKALGNQQPSWDSEDSSNFKDVGSKGK                        127
    |||||||||||||||||||||||||||
101 PKALGNQQPSWDSEDSSNFKDVGSKGK                        127
```

The data given below shows that HUMGRP5E splice variants of the present invention can be used as useful diagnostic agents for lung cancer. In particular, differential overexpression in Small Cell Lung Cancer cells (as opposed to normal lung cells and normal tissue of other types) was demonstrated through determination of mRNA expression, while antibodies selective for HUMGRP5E_P5 (SEQ ID NO:1300) splice variant were found to be capable of detecting HUMGRP5E_P5 (SEQ ID NO:1300) splice variant in human serum (blood samples), further confirming the existence of HUMGRP5E_P5 (SEQ ID NO:1300) splice variant protein and its specific, differential expression in patients with Small Cell lung cancer. Antibodies raised against HUMGRP5E_P5 (SEQ ID NO:1300) splice variant showed that HUMGRP5E_P5 (SEQ ID NO:1300) splice variant is differentially detected in serum samples taken from subjects suffering from small cell lung carcinoma as compared to healthy subjects, thereby supporting the utility of HUMGRP5E_P5 (SEQ ID NO:1300) splice variant as a diagnostic agent for lung cancer. The experiments were performed as described in greater detail below.

Expression of GRP_HUMAN—Gastrin-Releasing Peptide (HUMGRP5E) Transcripts which are Detectable by Amplicon as Depicted in Sequence Name HUMGRP5Ejunc3-7 (SEQ ID NO:1648) in Normal and Cancerous Lung Tissues Expression of GRP_HUMAN—gastrin-releasing peptide transcripts detectable by or according to HUMGRP5Ejunc3-7 amplicon (SEQ ID NO:1648) and HUMGRP5Ejunc3-7F (SEQ ID NO:1646) and HUMGRP5Ejunc3-7R (SEQ ID NO:1647) primers was measured by real time PCR. In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing sample"), to obtain a value of fold up-regulation for each sample relative to median of the normal PM samples.

Figure 19:
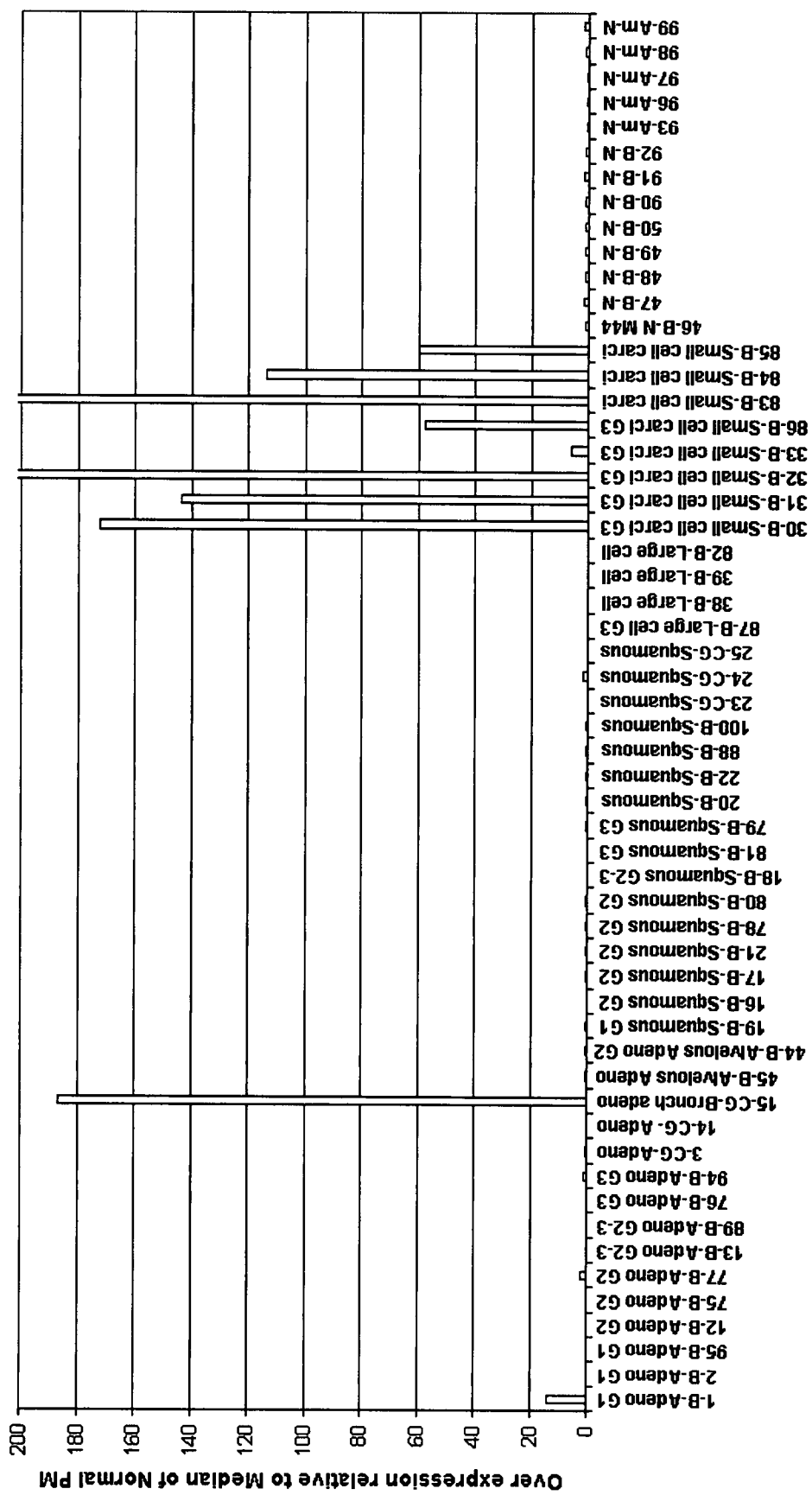
FIG. 19 is a histogram showing over expression of the gastrin-releasing peptide (HUMGRP5E) transcripts, which are detectable by amplicon as depicted in sequence name HUMGRP5Ejunc3-7 (SEQ ID NO: 1648), in several cancerous lung samples relative to the normal samples.

FIG. 19 is a histogram showing over expression of the above-indicated GRP_HUMAN—gastrin-releasing peptide transcripts in several cancerous lung samples relative to the normal samples. As is evident from FIG. 19, the expression of GRP_HUMAN—gastrin-releasing peptide transcripts detectable by the above amplicon in several cancer samples was significantly higher than in the non-cancerous samples (Sample Nos. 47-50, 90-93, 96-99, Table 2, "Tissue samples in testing sample"). Notably an over-expression of at least 10 fold was found in 2 out of 15 adenocarcinoma samples, and in 7 out of 8 small cells carcinoma samples.

Primer pairs are also optionally and preferably encompassed within the present invention; for example, for the above experiment, the following primer pair was used as a non-limiting illustrative example only of a suitable primer pair: HUMGRP5Ejunc3-7F forward primer (SEQ ID NO:1646); and HUMGRP5Ejunc3-7R reverse primer (SEQ ID NO:1647).

The present invention also preferably encompasses any amplicon obtained through the use of any suitable primer pair; for example, for the above experiment, the following amplicon was obtained as a non-limiting illustrative example only of a suitable amplicon: HUMGRP5Ejunc3-7 (SEQ ID NO:1648).

HUMGRP5Ejunc3-7F (SEQ ID NO:1646): ACCAGCCAC-CTCAACCCA

HUMGRP5Ejunc3-7R (SEQ ID NO:1647): CTGGAGCA-GAGAGTCTTTGCCT

HUMGRP5Ejunc3-7 (SEQ ID NO:1648): ACCAGCCAC-CTCAACCCAAGGCCCTGGGCAATCAG-
CAGCCTTCGTGGGATTCAGAGGATAG-
CAGCAACTTCA
AAGATGTAGGTTCAAAAGGCAAA-
GACTCTCTGCTCCAG Expression of GRP_HUMAN—Gastrin-Releasing Peptide (HUMGRP5E) Transcripts which are Detectable by Amplicon as Depicted in Sequence Name HUMGRP5Ejunc3-7 (SEQ ID NO:1648) in Different Normal Tissues Expression of GRP_HUMAN—gastrin-releasing peptide transcripts detectable by or according to HUMGRP5E junc3-7 amplicon (SEQ ID NO:1648) and HUMGRP5Ejunc3-7F (SEQ ID NO:1646) and HUMGRP5Ejunc3-7R (SEQ ID NO:1647) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the breast samples (Sample Nos. 33-35, Table 3, "Tissue samples on normal panel", above), to obtain a value of relative expression of each sample relative to median of the breast samples.

HUMGRP5Ejunc3-7F (SEQ ID NO:1646): ACCAGCCAC-CTCAACCCA

HUMGRP5Ejunc3-7R (SEQ ID NO:1647): CTGGAGCA-GAGAGTCTTTGCCT

Figure 20:
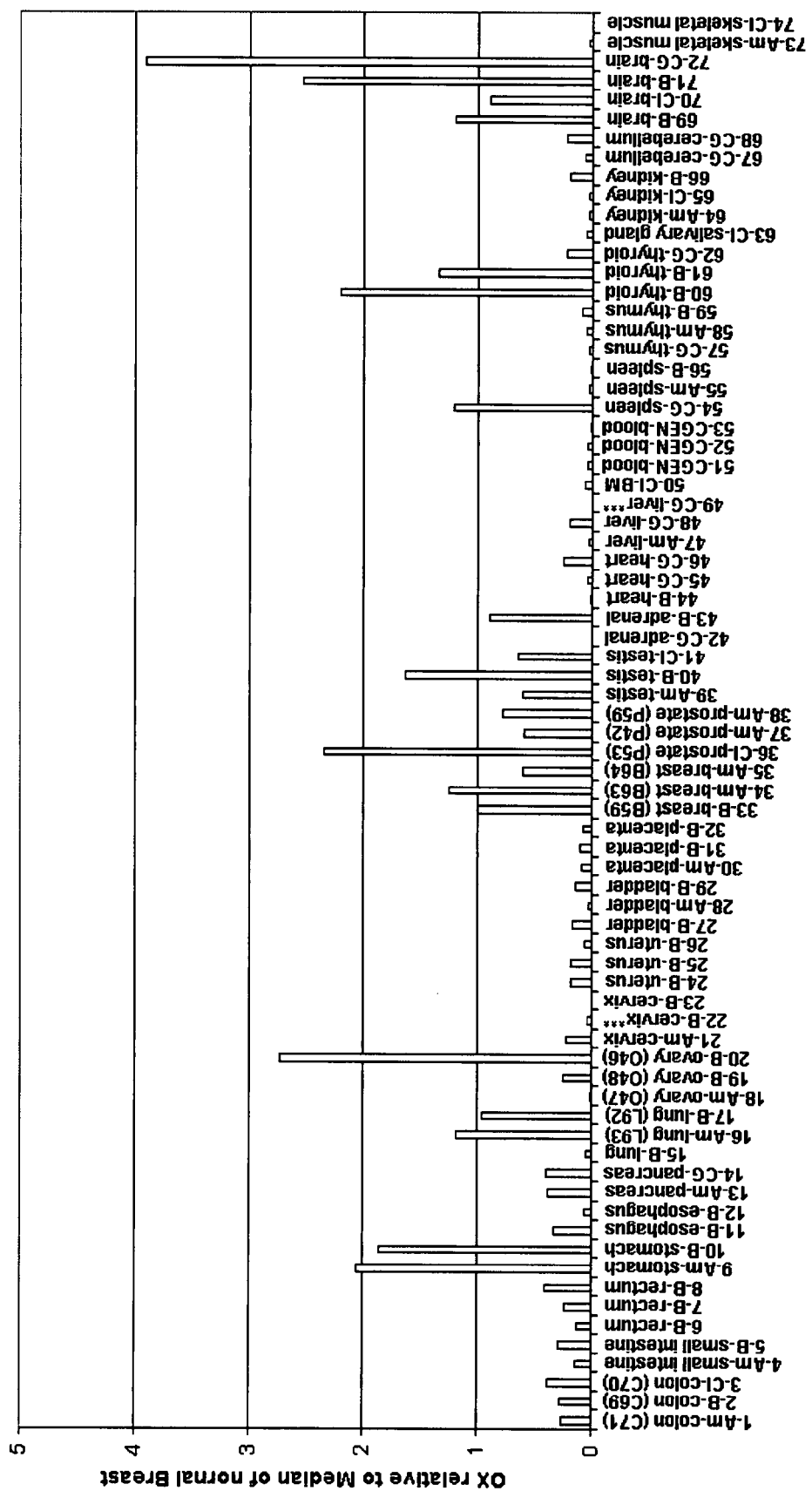
FIG. 20 is a histogram showing the expression of gastrin-releasing peptide (HUMGRP5E) transcripts, which are detectable by amplicon as depicted in sequence name HUMGRP5Ejunc3-7 (SEQ ID NO:1648), in different normal tissues.

HUMGRP5Ejunc3-7 (SEQ ID NO:1648): ACCAGCCAC-CTCAACCCAAGGCCCTGGGCAATCAG-CAGCCTTCGTGGGATTCAGAGGATAG-CAGCAACTTCA
AAGATGTAGGTTCAAAAGGCAAA-GACTCTCTGCTCCAG The results are shown in FIG. 20, demonstrating the expression of GRP_HUMAN—gastrin-releasing peptide (HUMGRP5E) transcripts which are detectable by amplicon as depicted in sequence name HUMGRP5Ejunc3-7 in different normal tissues.

Differential Expression of HUMGRP5E_P5 (SEQ ID NO:1300) in Small Cell Lung Carcinoma Patients as Compared to Healthy Subjects.

HUMGRP5E_P5 (SEQ ID NO: 1300) variant of the present invention results from alternative splicing of the GRP gene and it contains 142 amino acids. The first 121 amino acids from the N-terminal are shared with WT GRP 1 (SEQ ID NO:1421), WT GRP 2 (SEQ ID NO:1788) and WT GRP 3 (SEQ ID NO:1789). The next 6 amino acids are absent in WT GRP 2 (SEQ ID NO:1788), but appear in the other two known isoforms. In WT GRP 2 (SEQ ID NO:1788), shared 121 N-terminal region is followed by two amino acids which are absent in HUMGRP5E_P5 (SEQ ID NO:1300) and in the two other known isoforms (SEQ ID NOs: 1421 and 1789). In addition, WT GRP 2 (SEQ ID NO:1788) shares with HUMGRP5E_P5 (SEQ ID NO:1300) splice variant of the present invention a tail of 15 C-terminal amino acids. Thus, HUMGRP5E_P5 (SEQ ID NO:1300) splice variant of the present invention has a novel bridge connecting the 127 amino acids head of WT GRP isoforms 1 (SEQ ID NO:1421) and 3 (SEQ ID NO:1789) and the 15 amino acids tail of WT GRP isoform 2 (SEQ ID NO:1788).

The alignment comparison of the known GRP isoforms and the HUMGRP5E_P5 (SEQ ID NO: 1300) is presented in FIG. 98. In FIG. 98, the first N-terminal 127 amino acids common for HUMGRP5E_P5 (SEQ ID NO: 1300) splice variant, WT GRP 1 (SEQ ID NO:1421) and WT GRP 3 (SEQ ID NO:1789) are shown in bold: 2 amino acids that appear in the WT GRP 2 (SEQ ID NO:1788) and absent in the HUMGRP5E_P5 (SEQ ID NO: 1300) are double underlined: 15 amino acids common for HUMGRP5E_P5 (SEQ ID NO:1300) and WT GRP isoform 2 (SEQ ID NO:1788) are underlined.

1. Protein Production of HUMGRP5E P5 (SEQ ID NO:1300), WT GRP 1 (SEQ ID NO:1421) and HUMGRP5E P5 Representing Fragment (SEQ ID NO:1794)

As a tool for antibody development and ELISA assay development, the following recombinant proteins were produced: HUMGRP5E_P5 splice variant (GRP_142) (SEQ ID NO:1793) and WT GRP 1 (GRP_148) (SEQ ID NO:1792) proteins. In addition, a peptide representing the 15 amino acids (SEQ ID NO:1794) from the C-terminals tail of WT GRP 2 (SEQ ID NO:1788) and HUMGRP5E_P5 (SEQ ID NO:1300) was synthesized, to be used as a negative selection tool.

1.1 Cloning and Expression in Mammalian Cells 1.1.1. Cloning of HUMGRP5E P5 (SEQ ID NO:1793) (GRP-142) and WT GRP 1 (GRP-148) (SEQ ID NO:1792)

GRP sequences starting from the predicted protein cleavage site (corresponding to amino acid at position 54) were codon optimized to boost protein expression in mammalian cells. In addition, bacterial low-usage codons were eliminated to enable bacterial expression of the variants using the same DNA fragment.

The optimized genes were chemically synthesized at Gene-Art (Germany) using their proprietary gene synthesis technology, with the addition of DNA sequences encoding a 8×His tag downstream to the ectopic IL6 signal peptide. The resulting DNA sequences for GRP-148 (SEQ ID NO:1790) and GRP142 (SEQ ID NO:1791) are shown in FIGS. 99a and 99b, respectively. The IL6 signal peptide was added to enable secretion from mammalian cells, while the His-tag was added to facilitate protein purification. Flanking EcoRI and NotI sites were introduced at the 5' and 3' ends of the DNA fragments, respectively (underlined in FIGS. 99a and 99b). Protein sequences for GRP-148 (SEQ ID NO:1792) and GRP-142 (SEQ ID NO:1793) are shown in FIGS. 100a and 100b, respectively.

Figure 101A:
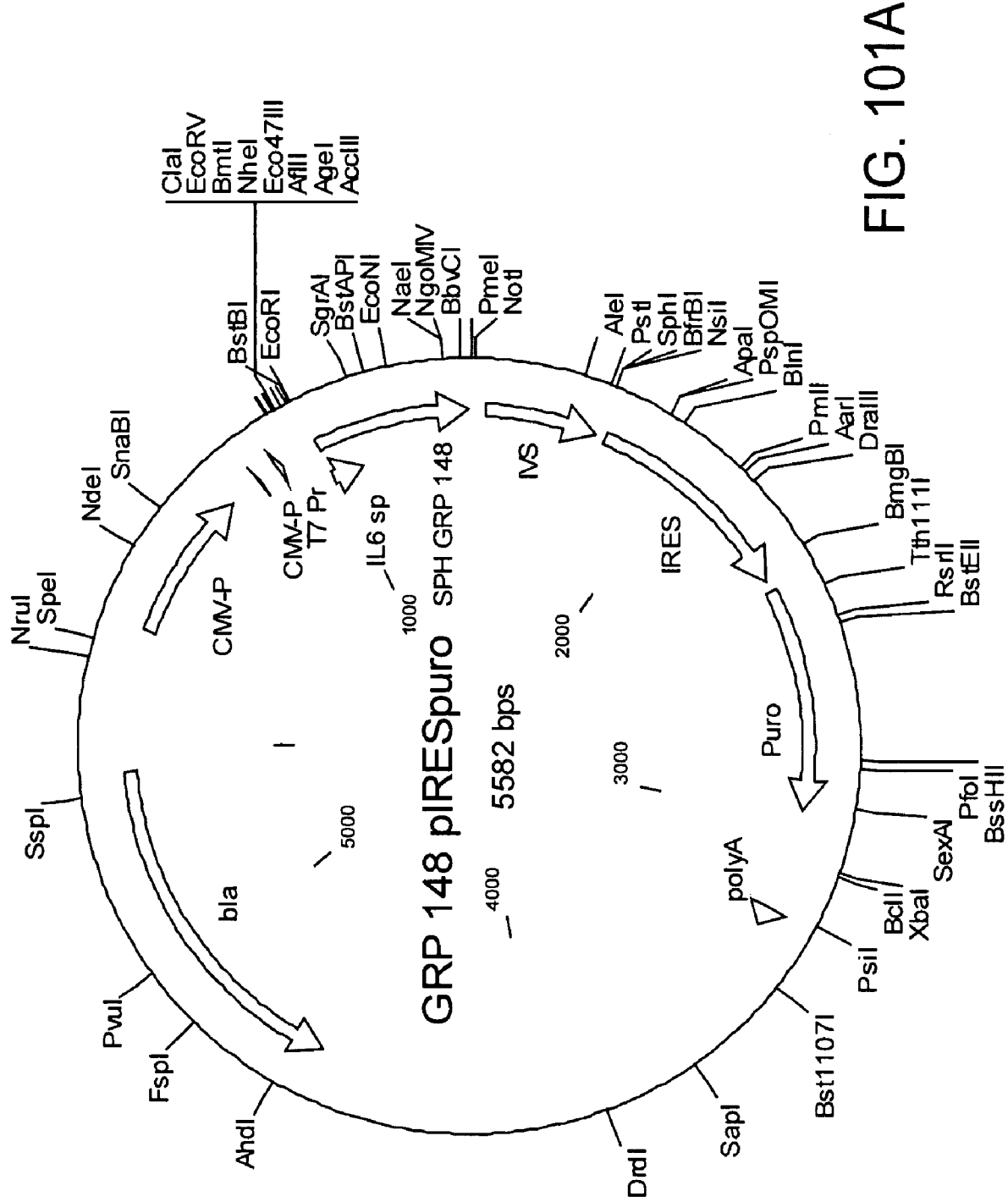
FIG. 101a shows the schematic presentation of GRP-148 in pIRESpuro.
Figure 101B:
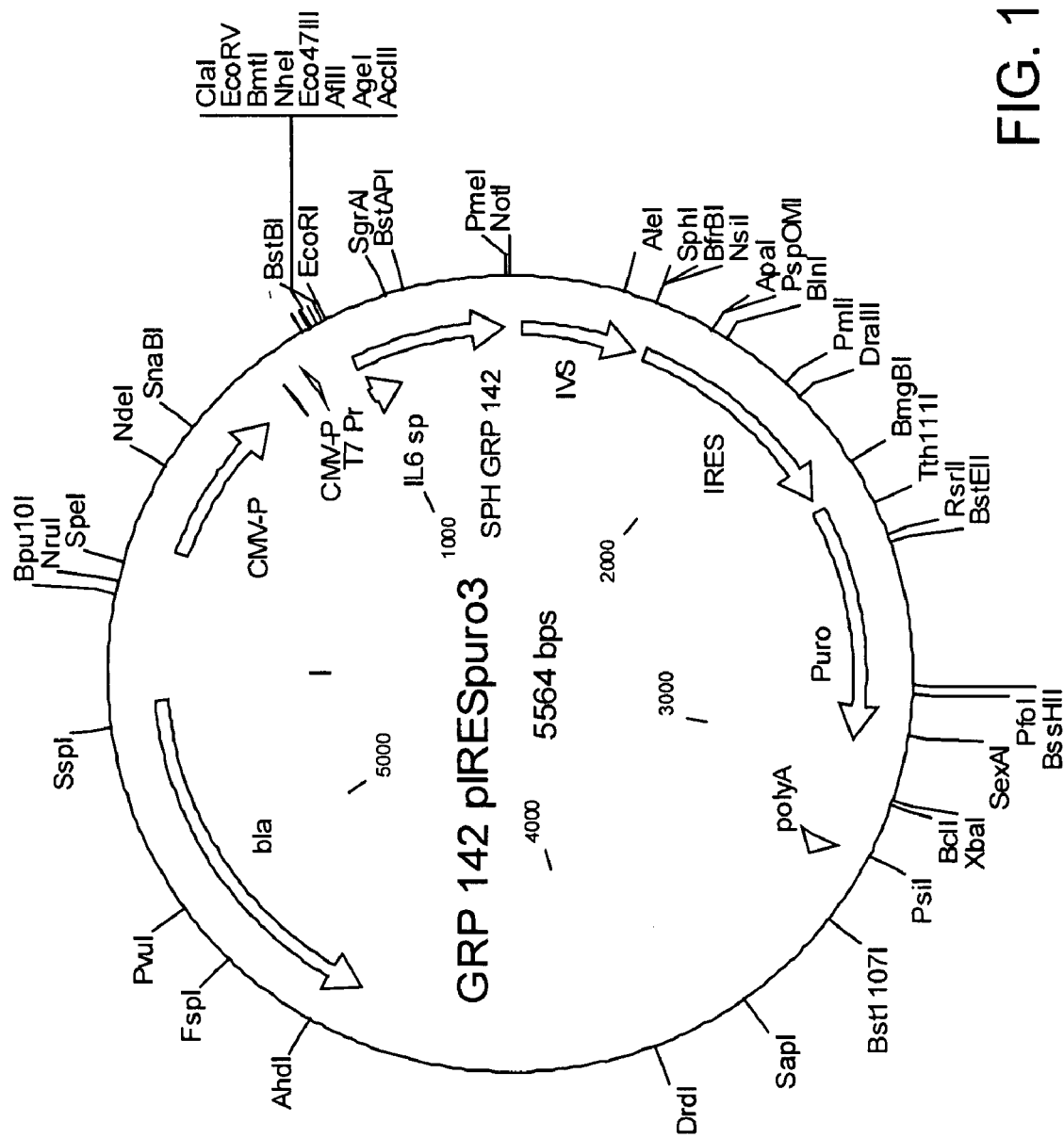
FIG. 101b shows the schematic presentation of GRP-142 in pIRESpuro.

The DNA fragments were cloned into EcoRI and NotI sites of pIRESpuro3 (Clontech, cat #PT3646-5) and the DNA sequence was verified. Plasmid maps are shown in FIG. 101a and 101b.

The expected MWs of the 2 mammalian proteins are:

GRP142 (SEQ ID NO:1793) 11.4 kDa

GRP148 (SEQ ID NO:1792) 12.0 kDa 1.1.2. Mammalian Expression of GRP Proteins

GRP constructs were transfected into HEK-293T cells (ATCC catalog number CRL-11268) as follows: One day prior to transfection, one well in a 6 well plate was plated with 500,000 cells in 2 ml DMEM (Dulbecco's modified Eagle's medium; Biological Industries, Cat#: 01-055-IA) containing 10% FBS and incubated at 37° C. in a 5% $CO_2$ humidified incubator. Transfection was done by FuGENE 6 Transfection Reagent (Roche, Cat#: 1-814-443) according to manufacturer's protocol. Following 48 h, transfected cells were split and subjected to antibiotic selection using 5 microgram/ml puromycin. The surviving cells were propagated for 2-3 weeks.

Figure 102:
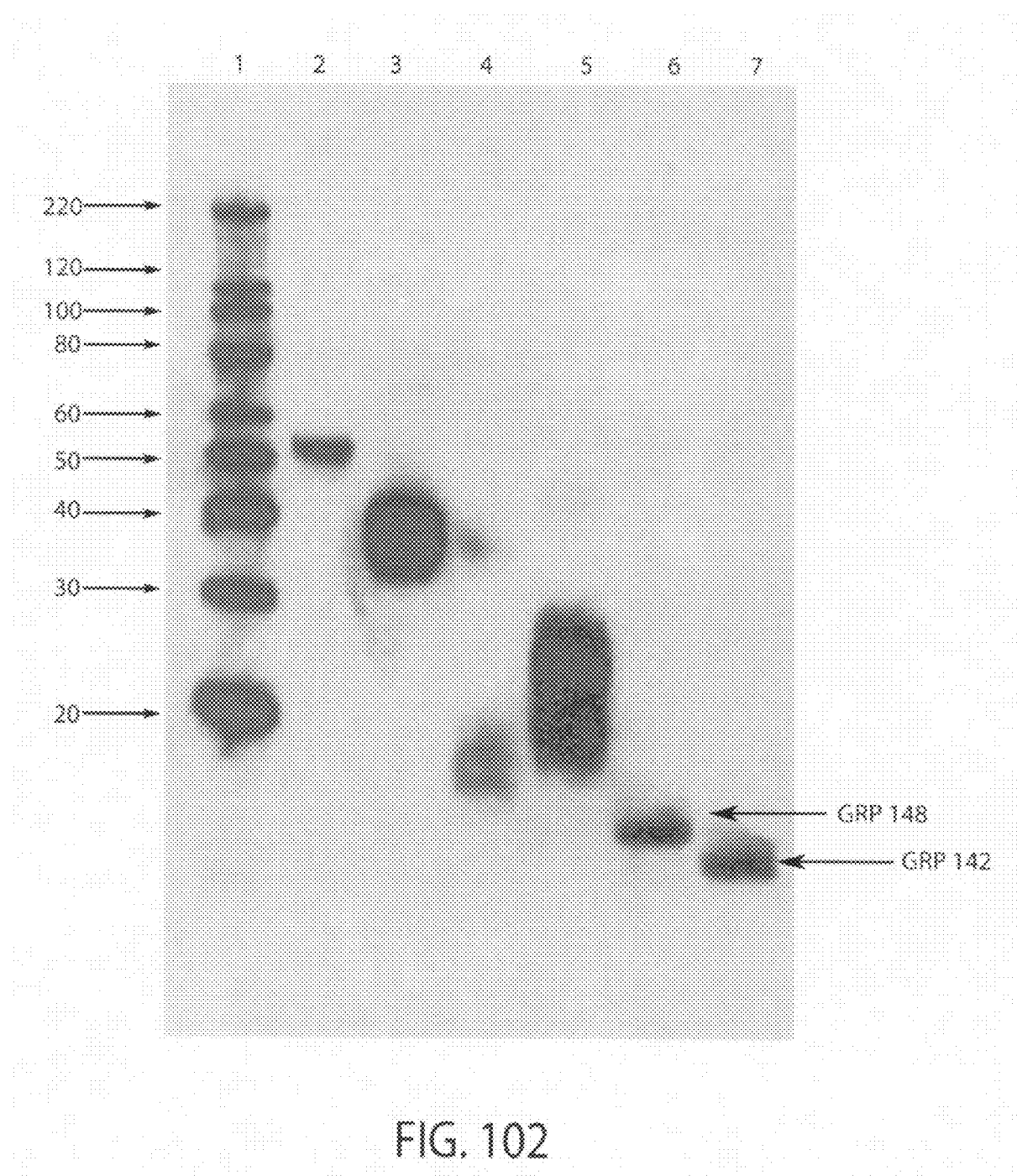
FIG. 102 shows the results of western blot analysis of mammalian expression of GRP proteins using anti His antibodies. Lane 1 shows the MW markers; Lanes 2-6 represent irrelevant proteins; Lane 7 represents GRP 148 (SEQ ID NO:1792); Lane 8 represents GRP 142 (SEQ ID NO:1793).

Expression of the recombinant proteins in supernatant of transfected cells was verified by Western Blot (WB) analysis using anti His antibodies (Serotec, Cat. # MCA1396) as shown in FIG. 102, lanes 6 and 7.

1.2. Production and Purification of GRP-148 (SEQ ID NO: 1792)

1.2.1. Mammalian Production of the GRP-148 (SEQ ID NO: 1792)

In order to produce sufficient amounts of the protein, HEK293T cells expressing GRP-148 (SEQ ID NO:1792)

were further propagated in serum-free medium as described below. Cells were taken from a T-80 flask containing serum supplemented medium after trypsinization, and were transferred into shake flasks containing serum free medium (EX-CELL293, JRH)) supplemented with 4 mM glutamine and selection antibiotics (5 ug/ml puromycin). Cultures were incubated at 37° C. on a shaker, at 100 RPM, and were diluted into a consecutive shake flask containing fresh medium when cell density reached 2–3.1×10$^6$ cell/ml. After several passages in serum-free medium the adapted cells served as an inoculum for production.

Production of GRP 148 (SEQ ID NO: 1792) was carried out in stirred-tank bioreactor equipped with an acoustic cell retention device (ADI Autoclavable Glass Bioreactor, Applikon and BioSep10, Applisens), operated in perfusion mode. The bioreactor was seeded with cell density of 1.1×10$^6$ cells/ml, in a final working volume of 3.5 L. After growth phase of 4 days, a production phase of 17 days in serum-free medium supplemented with 4 mM glutamine (without selection antibiotics) was carried out during which the growth temperature was reduced from 37° C. to 34° C. During production phase, cell density reached 2.6×10$^7$ cells/ml and the culture was fed at perfusion rate of 1-3 replacements per day. The total of 112 L of harvest collected was filtered through a 0.22 um filter and used for protein purification. GRP 148 (SEQ ID NO:1792) harvest was concentrated approximately 10 fold and the buffer was exchanged to diafiltration buffer (50 mM NaH$_2$PO4, 0.3 M NaCl, pH 8.0) using PALL ultrafiltration system. Imidazole solution (2M pH 8.0) was added to a final concentration of 10 mM, the harvest was filtered through 0.22 um filter).

1.2.2 Purification of the GRP-148 (SEQ ID NO:1792).

Purification process was carried out using a gravity-flow column (Econo-pac 20 ml, BioRad) for binding, and AKTA Explorer (GE Healthcare) for washing and elution. 1 ml Ni-NTA was washed and equilibrated in a gravity-flow column. The resin was transferred into a 250 ml vessel, the treated harvest (total volume 0.2 L) was added and incubated over night rolling at 4° C. to allow binding of the protein. On the following day the resin was packed in a 5/50 Tricorn column (GE Healthcare). The column was connected to the AKTA system and washed with 15 CV (column volumes) of buffer A (50 mM NaH$_2$PO4, 0.3 M NaCl, 10 mM Imidazole, pH 8.0) at flow rate of 1 ml/min. Elution was carried out with 10 CV of buffer of buffer B (50 mM NaH$_2$PO4, 0.3 M NaCl, 250 mM Imidazole, pH 8.0 at a flow-rate of 0.4 ml/min. The eluted fractions were pooled and dialyzed against dialysis buffer (Dulbecco's Phosphate bufferes saline pH 7.4 (w/o Ca, w/o Mg)) over night at 4° C. with 3 buffer exchanges of 5 L each. The dialyzed protein was filtered through 0.45 um filter, aliquoted and stored at –70° C.

Figure 103:
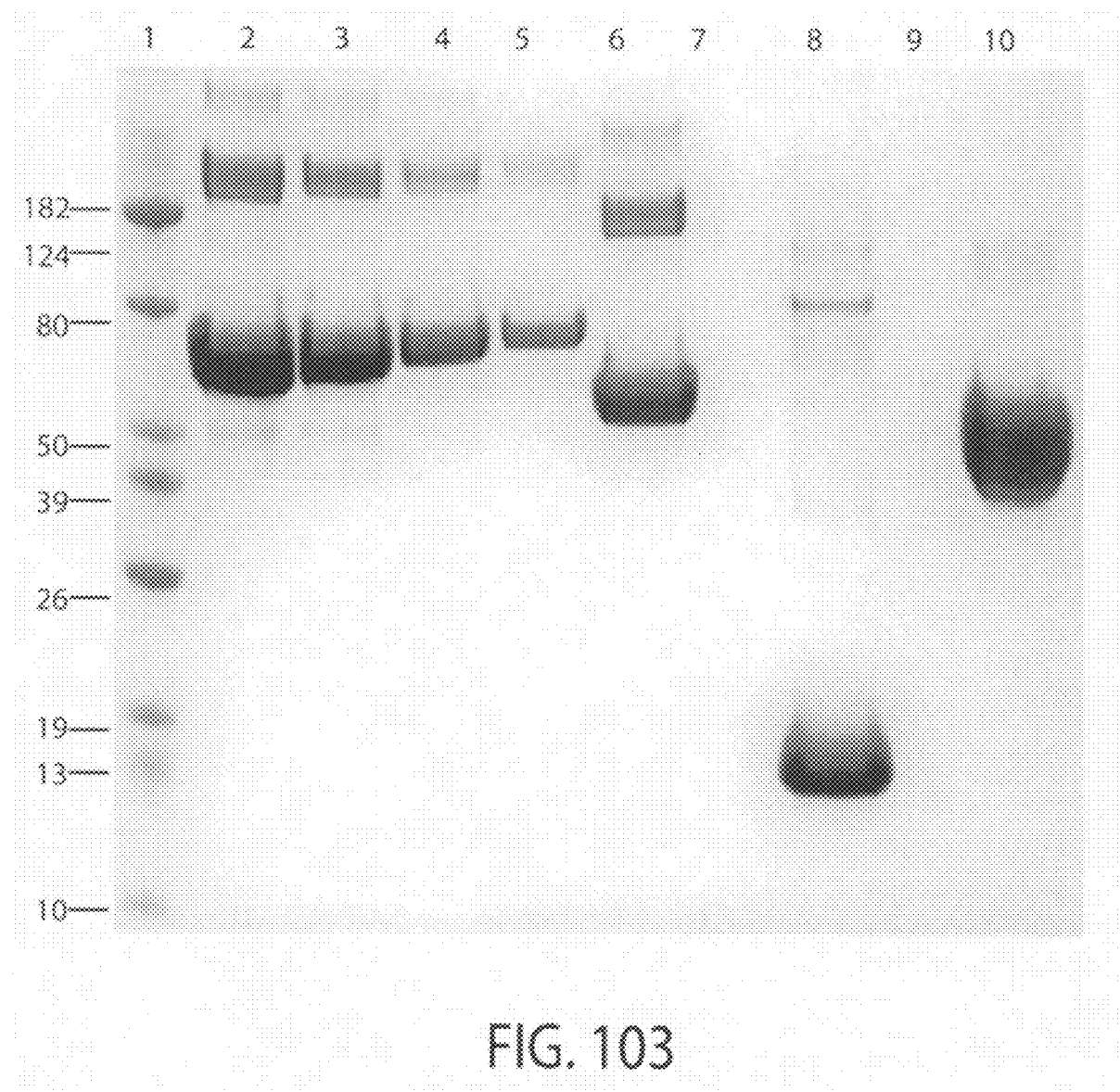
FIG. 103 shows the results of SDS-PAGE, Coomassie staining, demonstrating the analysis of purified GRP-148, shown in lane 8. Lane 1 represents a MW marker; Lanes 2-5 represents BSA 2 mg/ml, 1 mg/ml, 0.5 mg/ml, 0.25 mg/ml, respectively; Lane 6 represents BSA 1 mg/ml no DTT; Lanes 7 and 9 are empty; Lane 10 shows irrelevant protein.

Samples of the Purified Proteins were Analyzed by SDS-Page Stained by Coomassie, as Shown in FIG. 103. the Identity of the Purified Protein was Verified by Mass Spectrometry Analysis.

1.3. Mammalian Production and Purification of the GRP-142 (SEQ ID NO: 1793)

4.3.1 Mammalian Production of the GRP-142 (SEQ ID NO: 1793)

In order to produce sufficient amounts of the protein, the HEK293T cells expressing GRP-142 (SEQ ID NO: 1793) cells were further propagated in serum-free medium as described below. HEK293T cells expressing GRP-142 (SEQ ID NO: 1793) were taken from a T-80 flask containing serum supplemented medium after trypsinization, and were transferred into shake flasks containing serum free medium (EX-CELL293, JRH) supplemented with 4 mM glutamine and selection antibiotics (5 ug/ml puromycin). Cultures were incubated at 37° C. on a shaker, 100 RPM, and when cell density reached 2-4×10$^6$ cell/ml, the cells were diluted into a consecutive shake flask containing fresh medium. After several passages in serum-free medium the adapted cells served as an inoculum for production.

Production-phase growth of GRP-142 (SEQ ID NO:1793) was carried out in a hollow-fiber bioreactor (Accusyst-Maximizer, Biovest) operated in perfusion mode. The hollow-fiber cultureware (1.5 m$^2$, cellulose acetate double column) was inoculated with 8.5×10$^9$ viable cells. The culture was fed with basal medium (IMDM supplemented with additional 2 mM glutamine) on the non-cell side of the fibers (intra-capillary), and with a complete serum-free-medium (EX-CELL293, JRH) on the cell side of the fibers (extra-capillary).

The production was carried out for 75 days, during which a total of 325 L of harvest were collected. Due to the low size of the GRP-142, it passed through the fiber. Hence, harvest was collected from both the intra-capillary (11 L) and the extra-capillary (314 L) fluids. All harvest batches were filtered through a 0.22 um filter and used for protein purification.

1.3.2 Purification of the GRP-142 (SEQ ID NO:1793)

The purification process was carried out using a gravity column for binding, and AKTA Explorer (GE Healthcare) for washing and elution. 1 ml Ni-NTA was washed and equilibrated in a 20 ml gravity column. The resin was transferred into a 500 ml vessel, the treated harvest (total volume of 0.54 L) was added and incubated over night on a roller at 4° C. to allow binding of the protein. On the following day the resin was packed in a 5/50 Tricorn column. The column was connected to the AKTA system and washed with buffer A at flow rate of 1 ml/min 15 CV. Elution was carried out by applying buffer 10CV of buffer at a flow-rate of 0.4 ml/min. The eluted fractions were pooled and dialyzed against dialysis buffer over night at 4° C. with 3 volume exchange of 5 L each. The dialyzed protein was filtered through 0.45 um filter, aliquoted and stored at –70° C.

Figure 104:
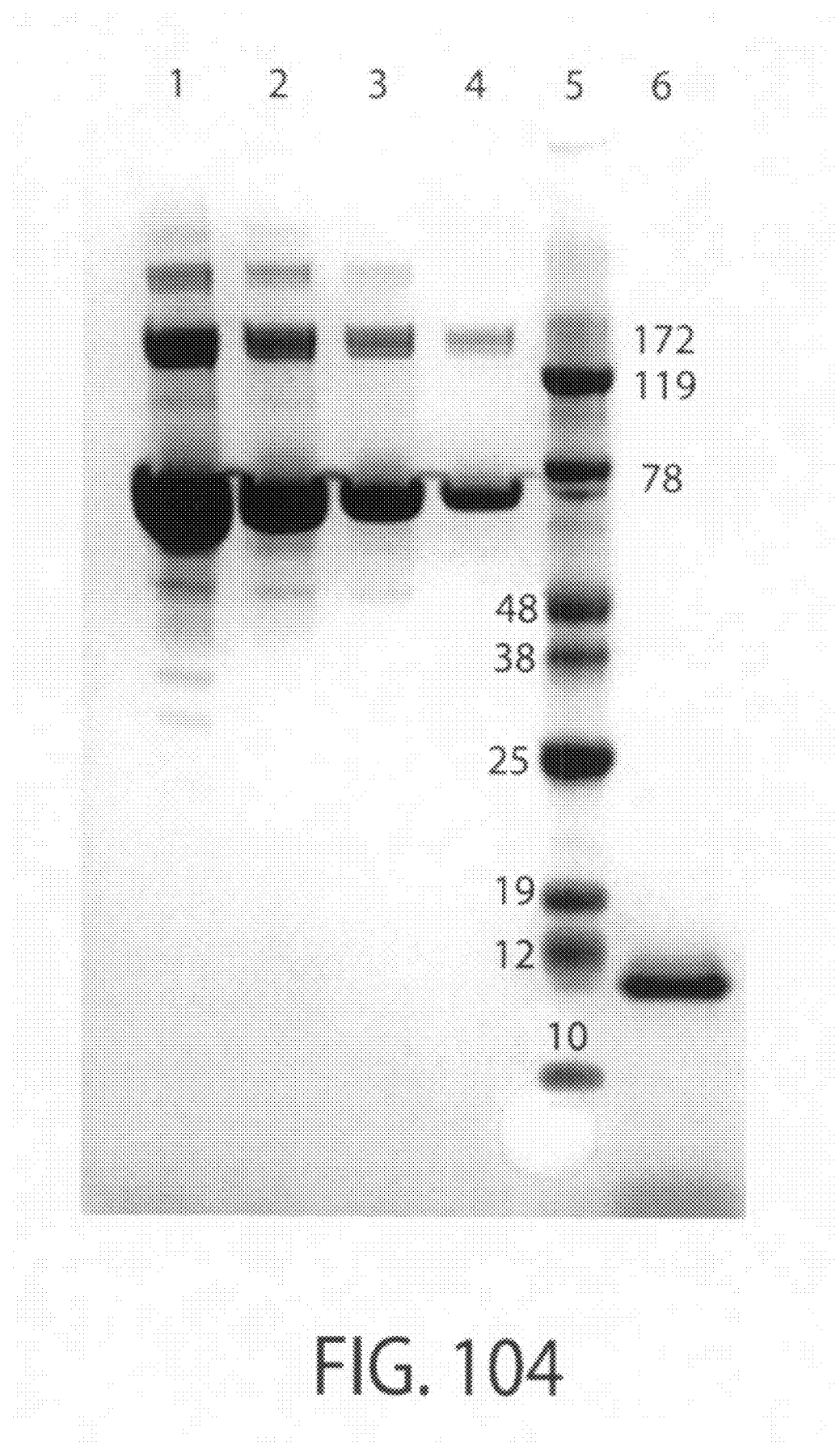
FIG. 104 shows SDS-PAGE, Coomassie stained gel analysis of GRP-142 (SEQ ID NO:1793), shown in lane 6. Lanes 1-4 represents BSA 1 mg/ml, 0.5 mg/ml, 0.25 mg/ml, 0.1 mg/ml, respectively; Lane 5 corresponds to MW Marker (Cambrex prosieve).

The identity of the purified proteins was verified by mass spectrometry analysis. Samples of the purified proteins obtained in all above purification bathes were analyzed by SDS-PAGE stained by Coomassie, as shown in FIG. 104.

1.4. HUMGRP5E P5 C-Terminal Peptide Tail (SEQ ID NO:1794)

A peptide of 16 amino acids (SEQ ID NO:1794) comprising of 15 amino acids common to HUMGRP5E_P5 (SEQ ID NO:1300) splice variant and WT GRP 2 (SEQ ID NO:1788) isoform and C-terminal Cys (added to facilitate coupling to BSA and agarose beads) was synthesized by Sigma-Aldrich Israel-LTD with a purity of >95%. HUMGRP5E_P5 C-terminal peptide tail sequence (DSPS16) (SEQ ID NO:1794): H-Asp-Ser-Leu-Leu-Gln-Val-Leu-Asn-Val-Lys-Glu-Gly-Thr-Pro-Ser-Cys-OH 2. Antibody Development In order to test HUMGRP5E_P5 (SEQ ID NO:1300) protein expression pattern in serum samples of diseased and healthy individuals, specific polyclonal antibodies were developed as described below.

The antibody of interest had to recognize specifically HUMGRP5E_P5 (SEQ ID NO:1300), without recognizing WT GRP 1 (SEQ ID NO:1421) and without recognizing the HUMGRP5E_P5 C-terminal peptide tail (SEQ ID NO:1794), common to the HUMGRP5E_P5 variant of the present invention (SEQ ID NO:1300) and to the known GRP-2 isoform (SEQ ID NO:1788). Therefore, serum titers as well as resultant antibodies were tested against all three protein/peptide preparations following a successful recognition of the HUMGRP5E_P5 (SEQ ID NO:1300)-specific immunogen.

Peptide Design and Synthesis

One peptide was selected as HUMGRP5E_P5 (SEQ ID NO: 1300)-specific immunogen for polyclonal antibody development. The peptide sequence in the area of the unique bridge was used as a template.

Selected HUMGRP5E_P5 (SEQ ID NO: 1300)-specific immunogen: The primary sequence of the immunogen peptide (CGEN0601 (SEQ ID NO: 1795)) is shown below. Terminal cysteine residue was used to facilitate coupling via m-maleimidobenzoyl-N-hydroxysuccinimide ester (MBS) to Keyhole Limpet Hemocyanin (KLH).

Peptide CGEN0601 (SEQ ID NO: 1795): Ac-SKGKD-SLLQVL-Ahx-C-amide

This peptide represents an internal region of the protein sequence and it was therefore blocked at the amino terminal end by acetylation and at its carboxy end by amidation. The illustration in FIG. 105 shows the sequence of the selected immunogen marked on the primary sequence of the HUMGRP5E_P5 (SEQ ID NO:1300) protein.

The immunogen peptide was synthesized using a conventional technology (50 mg; purity ≧90%). The peptide was conjugated to Keyhole Limpet Hemocyanin (KLH) and Bovine Serum Albumin (BSA) using an m-maleimidobenzoyl-N-hydroxysuccinimide ester (MBS) linker.

2.2 Rabbit Polyclonal Antibody Development 2.2.1. Rabbit Immunization and Sera Testing Three New Zealand White Rabbits (8346, 8348 and 8349) were immunized with CGEN0601 (SEQ ID NO:1795) conjugated with KLH. Immunization schedule and production bleed schedules are summarized in Tables 136 and 137, respectively.

TABLE 136

Summary of rabbit immunization and test bleed schedule.

| | | Scheduled Date | | | | |
|---|---|---|---|---|---|---|
| Rabbit # | Pre Bleed | Initial Injection (500 μg ID/CFA) | Boost #1 (250 μg ID/IFA) | Boost #2 (250 μg SC/IFA) | Boost #3 (250 μg SC/IFA) | Test Bleed #1 |
| 8346 | Jun. 12, 2006 | Jun. 16, 2006 | Jun. 23, 2006 | Jun. 30, 2006 | Jul. 14, 2006 | Jul. 24, 2006 |
| 8348 | Jun. 12, 2006 | Jun. 16, 2006 | Jun. 23, 2006 | Jun. 30, 2006 | Jul. 14, 2006 | Jul. 24, 2006 |
| 8349 | Jun. 12, 2006 | Jun. 16, 2006 | Jun. 23, 2006 | Jun. 30, 2006 | Jul. 14, 2006 | Jul. 24, 2006 |

TABLE 137

Summary of rabbit production bleed schedule.

| | Scheduled Date | | | | | | | | |
|---|---|---|---|---|---|---|---|---|---|
| Rabbit # | Production Bleed #1 | Production Bleed #2 | Production Bleed #3 | Production Bleed #4 | Production Bleed #5 | Production Bleed #6 | Production Bleed #7 | Production Bleed #8 | Production Bleed #9 |
| 8346 | Aug. 3, 2006 | Aug. 14, 2006 | Aug. 21, 2006 | Sep. 25, 2006 | | | | | |
| 8348 | Aug. 3, 2006 | Aug. 14, 2006 | Aug. 21, 2006 | Sep. 11, 2006 | Sep. 18, 2006 | Sep. 25, 2006 | Oct. 9, 2006 | Oct. 16, 2006 | Nov. 13, 2006 |
| 8349 | Aug. 3, 2006 | Aug. 14, 2006 | Aug. 21, 2006 | Sep. 11, 2006 | Sep. 18, 2006 | Sep. 25, 2006 | Oct. 9, 2006 | Oct. 16, 2006 | Nov. 13, 2006 |

| | Scheduled Date | | | | | | | | |
|---|---|---|---|---|---|---|---|---|---|
| Rabbit # | Production Bleed #10 | Production Bleed #11 | Production Bleed #12 | Production Bleed #13 | Production Bleed #14 | Production Bleed #15 | Production Bleed #16 | Production Bleed #17 | Terminal Bleed |
| 8346 | | | | | | | | | Oct. 30, 2007 |
| 8348 | Nov. 20, 2006 | Nov. 27, 2006 | Dec. 11, 2006 | Dec. 18, 2006 | Dec. 25, 2006 | | | | Jan. 2, 2007 |
| 8349 | Nov. 20, 2006 | Nov. 27, 2006 | Dec. 11, 2006 | Dec. 18, 2006 | Dec. 25, 2006 | Jan. 2, 2007 | Jan. 8, 2007 | Jan. 15, 2007 | XXXXX |

Production bleeds were collected and antibody titers were determined by ELISA using CGEN0601 (SEQ ID NO: 1795) peptide conjugated with BSA, recombinant HUMGRP5E_P5 (SEQ ID NO: 1793) splice variant, WT GRP 1 protein (SEQ ID NO:1792) and HUMGRP5E_P5 C-terminal peptide tail (SEQ ID NO: 1794).

Rabbit 8346 showed a lower antibody titer against the splice variant (SEQ ID NO:1793)(SVr) protein as compared to rabbits 8348 and 8349, therefore only few production bleeds were collected from this rabbit and its bleeds were not purified.

2.2.2 Rabbit Polyclonal Antibody Affinity Purification

Affinity purification was performed on all production bleeds collected from the two rabbits (8348 and 8349) using a CGEN0601 (SEQ ID NO: 1795) immunoaffinity resin. Two passes of PBS diluted antiserum (1:1) were run on immunoaffinity resin prepared by coupling 10 mg Peptide CGEN0601 (SEQ ID NO:1795) (Lot 06-2996-2137) [Sequence: Ac-SKGKDSLLQVL-Ahx-C-amide] to agarose beads. The purified product was concentrated to approximately 1 mg/ml and dialyzed against 1XPBS. The yield obtained from these purifications is summarized in Table 138 below.

variant and low recognition of the WT GRP 1 protein (SEQ ID NO:1792). The binding of the purified antibodies to HUMGRP5E_P5 C-terminal peptide tail (SEQ ID NO:1794) was high in both preparations.

Rabbit 8349 (Lot # 18878C) had higher titers against HUMGRP5E_P5 (SEQ ID NO:1793) splice variant and lower titers against HUMGRP5E_P5 C-terminal peptide tail (SEQ ID NO:1794) as compared to Rb8348 (Lot #18980). Therefore, this lot was selected for cross absorption against the HUMGRP5E_P5 C-terminal peptide tail (SEQ ID NO:1794) in order to significantly decrease its recognition to known GRP isoforms.

The affinity purified antibody from rabbit 8349 was run over an immunoaffinity resin prepared by coupling 10.0 mg of GRP-negative control Peptide (DSPS16) (SEQ ID NO:1794) to agarose beads. The flow through was collected as the affinity purified cross adsorbed product. The eluant was collected as the pan reactive antibody. All purified products

TABLE 138

| Lot Number | Rabbit | Concentration | Volume | Total Yield | Buffer |
|---|---|---|---|---|---|
| 18878C | 8349 | 1.10 mg/ml | 37.0 ml | 40.7 mg | 0.02 M Potassium Phosphate, 0.15 M Sodium Chloride, pH 7.2 |
| 18980C | 8348 | 1.0 mg/ml | 82.0 ml | 82.0 mg | 0.02 M Potassium Phosphate, 0.15 M Sodium Chloride, pH 7.2 |

Figure 106:
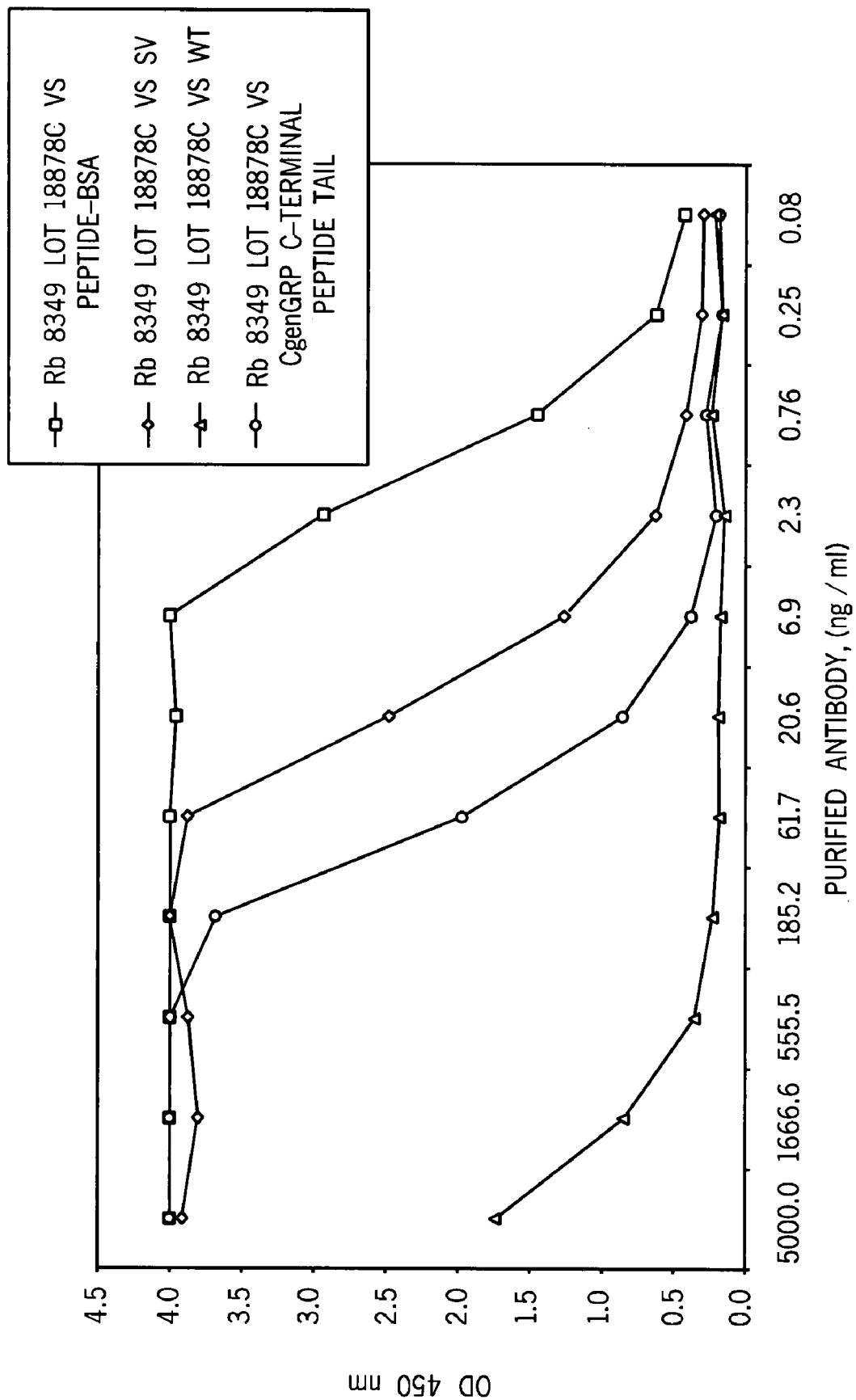
FIG. 106 shows ELISA results of CGEN0601 Affinity Purified Antibodies, Lot18878C, Rabbit 8349.
Figure 107:
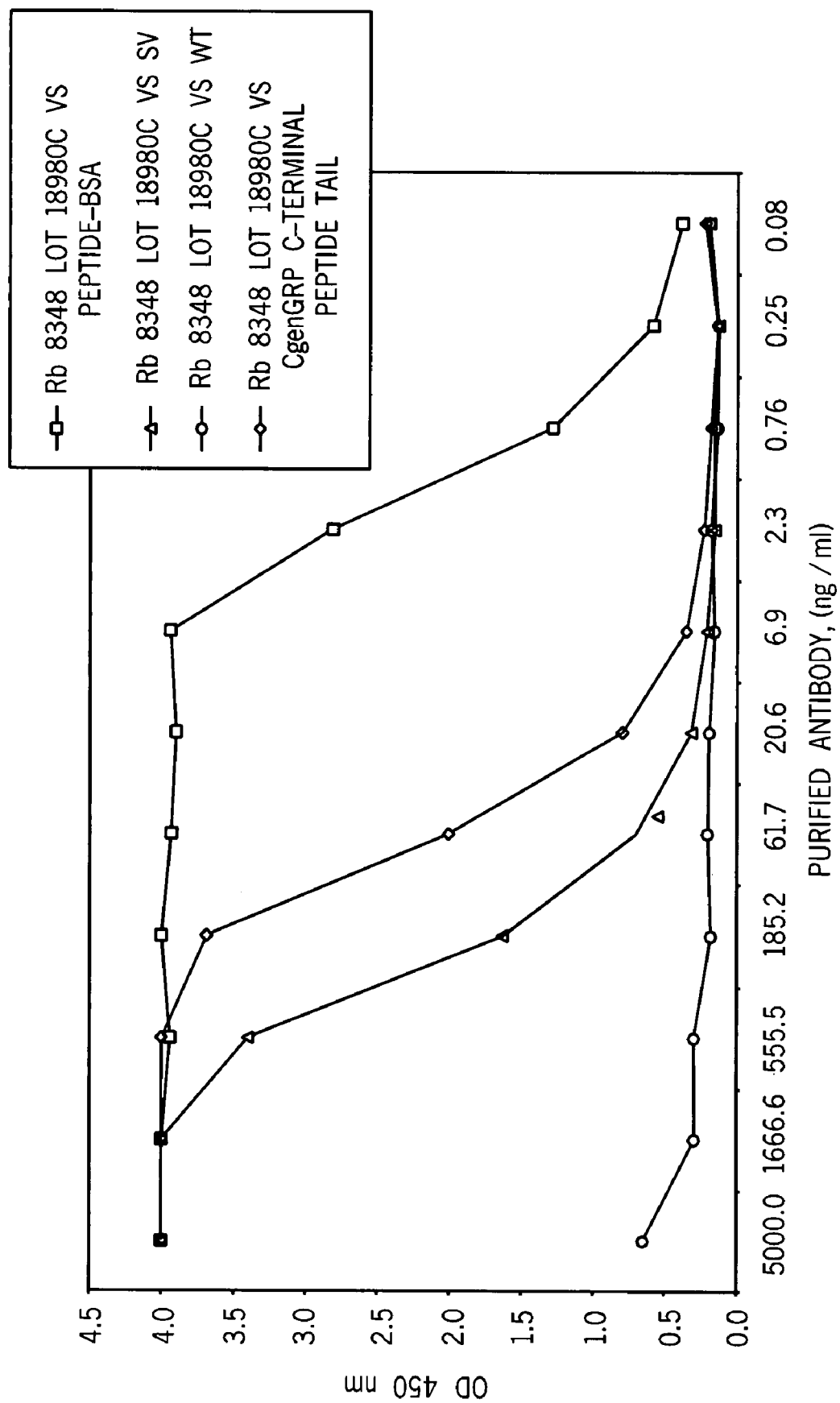
FIG. 107 shows ELISA results of CGEN0601 Affinity Purified Antibodies, Lot 18980C, Rabbit 8348.

Purified antibodies were assayed by ELISA for reactivity towards the immunogen (SEQ ID NO:1795) conjugated to BSA, splice variant protein (SEQ ID NO: 1793), wild type protein (SEQ ID NO:1792), and HUMGRP5E_P5 C-terminal peptide tail (SEQ ID NO:1794) conjugated to BSA. Results are summarized in FIGS. 106 and 107.

were concentrated to 11.0 mg/ml and dialyzed against 1xPBS. Prior to final vialing, each antibody was filter sterilized (0.22 μm). The cross absorbed product prepared from lot 18878C was named lot 18978C. The eluant—pan reactive antibody was named 18979C. Antibody yield from cross adsorption is presented in Table 139 below.

TABLE 139

Yield from cross adsorption of Rabbit 8349 (Lot 18878C).

| Lot Number | Rabbit | Concentration | Volume | Total Yield | Buffer |
|---|---|---|---|---|---|
| Rb 8439 Cross absorbed product Lot 18078C | 8349 | 1.5 mg/ml | 18.0 ml | 27.0 mg | 0.02 M Potassium Phosphate, 0.15 M Sodium Chloride, pH 7.2 |
| Rb 8349 Pan Reactive Lot 18979C | 8349 | 1.37 mg/ml | 2.3 ml | 3.1 mg | 0.02 M Potassium Phosphate, 0.15 M Sodium Chloride, pH 7.2 |

Figure 108:
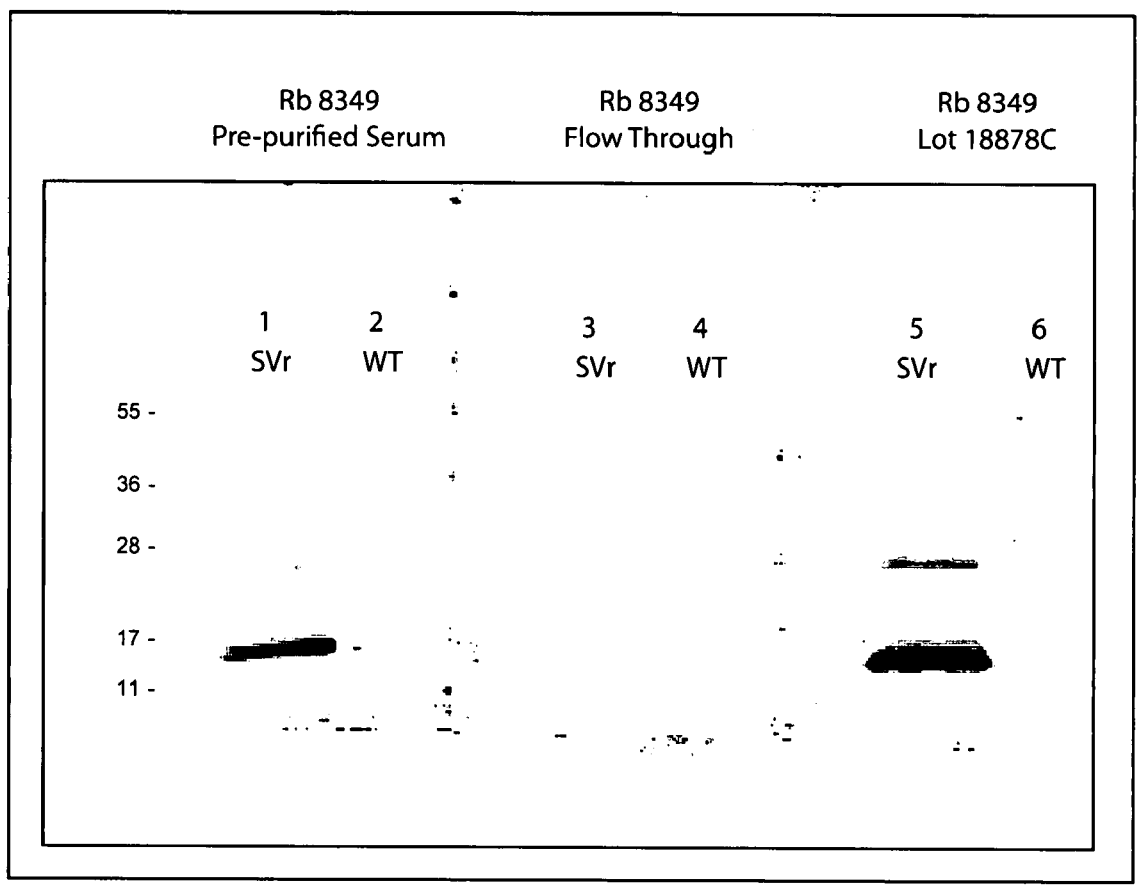
FIG. 108 shows Western Blot Data of Affinity Purified Antibody, Lot 18878C (Rabbit 8349). HUMGRP5E_P5 (SEQ ID NO: 1300) splice variant (SVr) and WT GRP precursor (SEQ ID NO:1421) (WT) were probed with pre-purified serum of the Rb 8349 (lanes 1 and 2), affinity purified antibody lot 18878C, Rb 8349 (lanes 5 and 6) and flow through from affinity purification, Rb 8349 (lanes 3 and 4).
Figure 109:
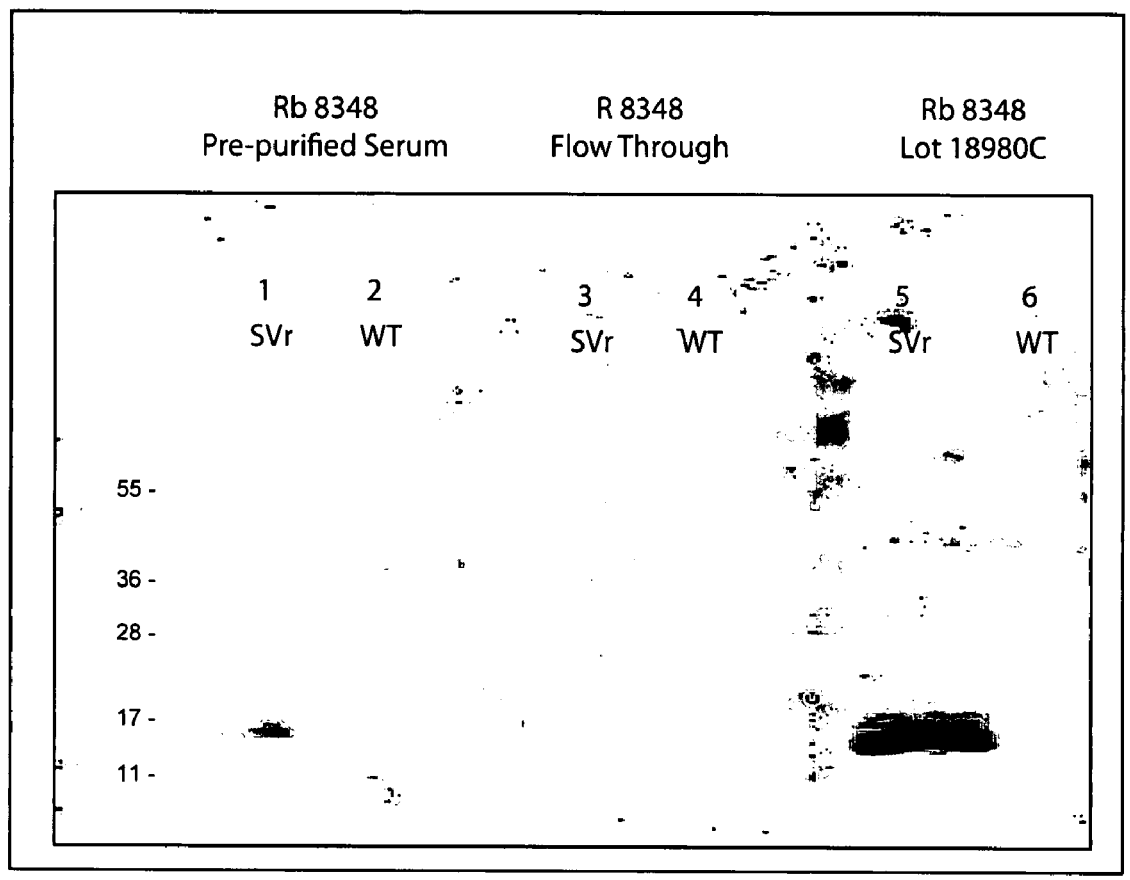
FIG. 109 shows Western Blot Data of Affinity Purified Antibody, Lot 18980C (Rabbit 8348).

Reactivity of the purified antibodies to both the splice variant and the wild type proteins was also tested by a Western blot analysis of both purified antibody preparations. The results suggested a good recognition of the HUMGRP5E_P5 (SEQ ID NO:1793) splice variant and no recognition of the WT GRP 1 (SEQ ID NO:1792) protein. The data is shown in FIGS. 108 and 109.

Figure 110:
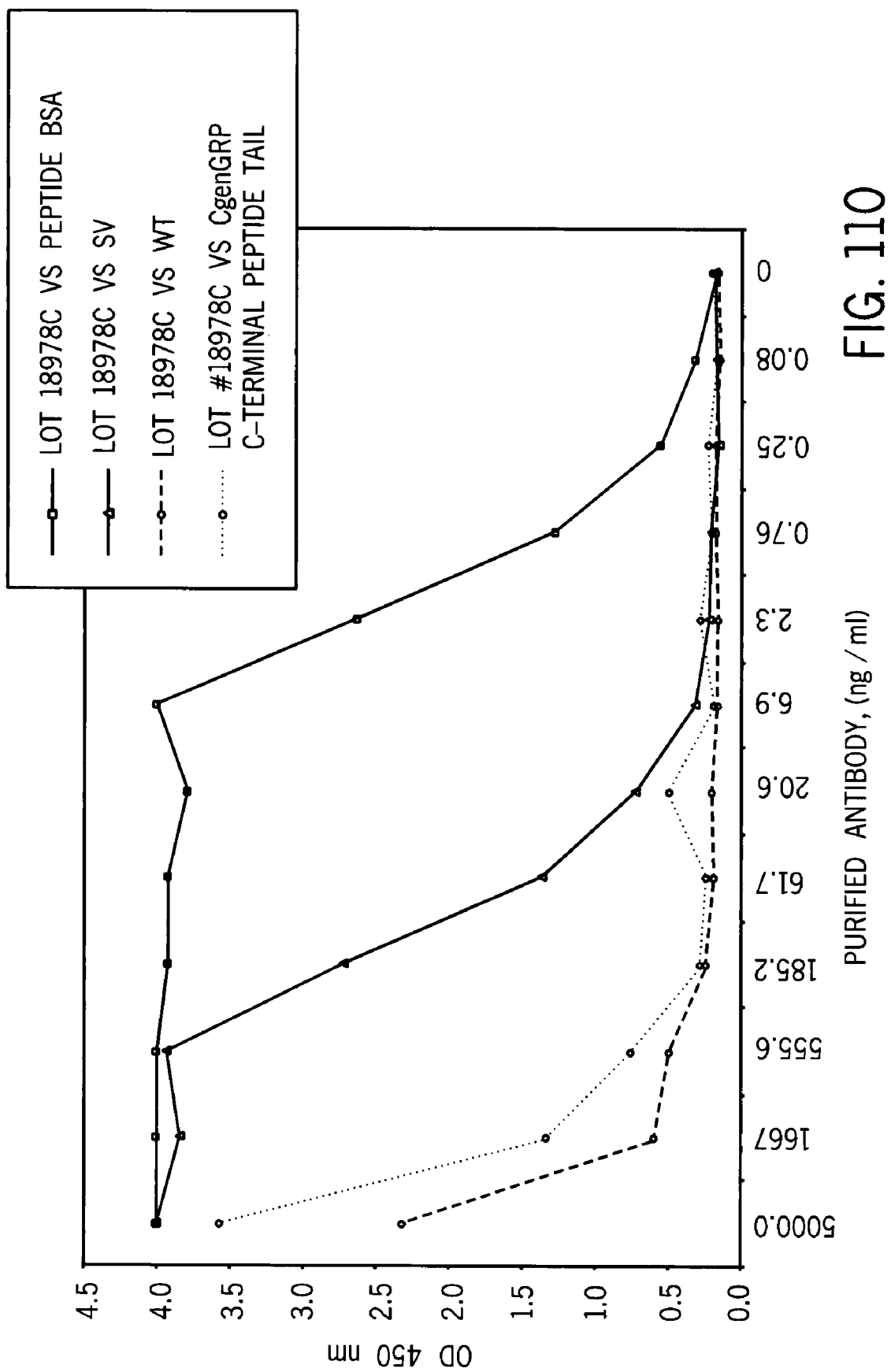
FIG. 110 shows ELISA Data of Rabbit 8349 Cross-adsorbed product (Lot 18978C).

The two antibody preparations described above showed a good binding to HUMGRP5E_P5 (SEQ ID NO:1793) splice Antibodies prepared by cross absorption (Rb 8349 cross absorbed product, lot#18978C) were assayed for reactivity towards the immunogen (SEQ ID NO:1795) conjugated to BSA, splice variant protein (SEQ ID NO:1793), wild type protein (SEQ ID NO:1792), and HUMGRP5E_P5 C-terminal peptide tail (SEQ ID NO:1794) conjugated to BSA. Results presented in FIG. 110.

The cross absorbed antibodies possessed a good recognition of HUMGRP5E_P5 (SEQ ID NO:1793) splice variant and a low recognition of both, WT GRP 1 (SEQ ID NO:1792)

and the HUMGRP5E_P5 C-terminal peptide tail (SEQ ID NO:1794). Therefore, this preparation was later used for assay development. 3. HUMGRP5E P5 (SEQ ID NO:1300) Assay Development Assay Development stage of HUMGRP5E_P5 (SEQ ID NO:1300) was carried out through CommonWealth Biotechnologies (CBI), Inc., a US-based service provider, using serum samples of Lung Cancer patients.

For assay development purposes polyclonal antibody preparation (Rockland polyclonal, Rabbit 8349 that was cross absorbed on the GRP-negative control peptide) was used. As indicated above, this antibody was developed against a synthetic peptide Acetyl-SKGKDSLLQVL-amide (SEQ ID NO:1795), comprising the unique bridge specific for HUMGRP5E_P5 (SEQ ID NO:1300) splice variant.

Three ELISA formats were developed in order to identify the most sensitive assay format for the detection of HUMGRP5E_P5 (SEQ ID NO:1300) protein in serum:
 a Sandwich ELISA
 Antibody capture competitive ELISA
 Antigen capture competitive ELISA 3.1 Sandwich ELISA In order to develop a sandwich ELISA test, the cross absorbed polyclonal antibody (Rb8349 cross absorbed product) has been tested both as a capture and a detector antibody. For serving as a detector, antibody was labeled with biotin. The sandwich assay format was not able to detect HUMGRP5E_P5 (SEQ ID NO:1793) spiked in serum in all the concentrations that were tested ($\leq 1$ ug/ml).

3.2 Antibody Capture Competitive ELISA

ELISA plates were coated with the antibody and its binding to biotin-labeled HUMGRP5E_P5 (SEQ ID NO: 1793) spiked in serum samples was assessed. Non-labeled HUMGRP5E_P5 (SEQ ID NO:1793) was tested as a competing antigen. The antibody capture assay format was the following (Format 1):

| | |
|---|---|
| Coat: | Rabbit 8349, cross absorbed product |
| Detector: | HUMGRP5E_P5 (SEQ ID NO: 1793) biotin-labeled protein |
| LOD for HUMGRP5E_P5 (SEQ ID NO: 1793): | ~14 ng/ml |

3.3 Antigen Capture Competitive ELISA

ELISA plates were coated with HUMGRP5E_P5 (SEQ ID NO:1793) splice variant protein and its binding to antibody pre-incubated with peptide-spiked serum samples was assessed. The antigen capture assay was the following (Format 2):

| | |
|---|---|
| Coat: | HUMGRP5E_P5 (SEQ ID NO: 1793) protein |
| Detector: | Rabbit 8349, cross absorbed product |
| LOD for HUMGRP5E_P5 (SEQ ID NO: 1793): | ~10 ng/ml |

The results observed with the various assay formats showed a comparable performance of both antigen and antibody capture competitive tests, with a slightly lower LOD for the format 2. This format 2 did not recognize spiked WT GRP 1 (SEQ ID NO:1792) and HUMGRP5E_P5 C-terminal peptide tail (SEQ ID NO:1794) samples (up to concentration of 0.88 nmol/ml which is equivalent to 10 ug/ml of the HUMGRP5E_P5 (SEQ ID NO:1793)).

It was therefore decided to continue with the antigen capture competitive assay format for serum samples testing.

4. Serum Screening

Serum of Small Cell Lung Cancer (SCLC) patient's sera and control sera (ProMedDx) were tested by HUMGRP5E_P5 antigen competitive assay described above.

4.1 Serum Samples Screening

Figure 111:
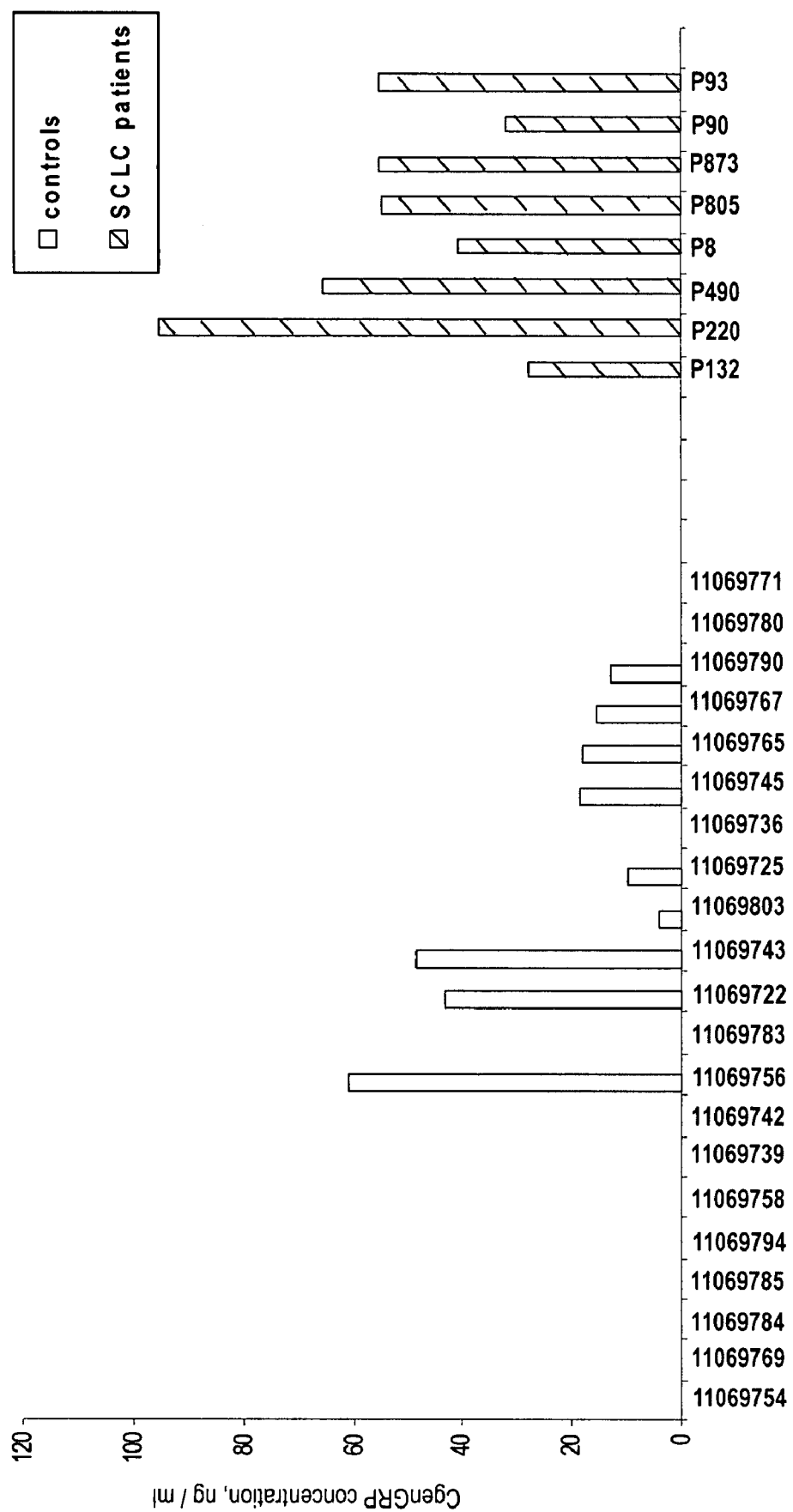
FIG. 111 shows concentration of HUMGRP5E_P5 (SEQ ID NO: 1300) in control and SCLC patients' sera.

Sera from eight Small Cell Lung Cancer (SCLC) patients and 21 gender-matched control sera (Mean age: 65y±7; 50 y±2, respectively) were assayed using optimized HUMGRP5E_P5 (SEQ ID NO:1300) antigen capture competitive assay (Format 2, above). The results are presented in Table 140 as well and in FIG. 111.

TABLE 140

Concentration of CgenGRP in control and SCLC patients'sera. Serum screening 7.1

| Lung cancer Sample ID | CgenGRP concentration, ng/ml | Normal controls Sample ID | Cgen GRP concentration, ng/ml |
|---|---|---|---|
| | | 11069742 | * |
| | | 11069756 | 61 |
| | | 11069783 | * |
| | | 11069722 | 43 |
| | | 11069743 | 48 |
| | | 11069803 | 4 |
| | | 11069725 | 10 |
| | | 11069754 | * |
| | | 11069769 | ** |
| | | 11069784 | * |
| | | 11069785 | * |
| | | 11069794 | * |
| | | 11069758 | * |
| P132 | 28 | 11069739 | * |
| P220 | 95 | 11069736 | * |
| P490 | 65 | 11069745 | 18 |
| P8 | 41 | 11069765 | 18 |
| P805 | 55 | 11069767 | 15 |
| P873 | 55 | 11069790 | 13 |
| P90 | 32 | 11069780 | * |
| P93 | 55 | 11069771 | * |
| Mean | 53 | Mean | 11 |
| St. Dev. | 21 | St. Dev. | 18 |

*Below LOD
**Detected, but below LOQL

The results revealed that HUMGRP5E_P5 (SEQ ID NO:1300) concentrations detected in SCLC sera are relatively higher than HUMGRP5E_P5 (SEQ ID NO:1300) concentrations detected in the control sera. The mean concentration level of HUMGRP5E_P5 (SEQ ID NO:1300) levels was 53.2±21.4 ng/ml for patients and 11.0±18.1 ng/ml for controls. Three control samples (out of the 21 tested) showed positive signals in the range observed for patients and 6 control samples showed signals lower than the range observed for patients. The remaining 12 controls had no signal. The results indicate that HUMGRP5E_P5 (SEQ ID NO:1300) can serve as a serum marker for the detection of SCLC patients.

The antibodies specific for HUMGRP5E_P5 (SEQ ID NO:1300) splice variant were able to detect HUMGRP5E_P5 (SEQ ID NO:1300) variant protein in serum samples, including in Small Cell lung cancer patients serum, however, sensitivity and reproducibility of the results were hampered by apparent low levels of the protein in serum and also by technical problems with the assays, according to additional results that are not shown.

Description for Cluster D56406

Cluster D56406 features 3 transcript(s) and 10 segment(s) of interest, the names for which are given in Tables 141 and 142, respectively, the sequences themselves are given at the end of the application. The selected protein variants are given in table 143.

TABLE 141

Transcripts of interest

| Transcript Name | Sequence ID No. |
|---|---|
| D56406_PEA_1_T3 | 22 |
| D56406_PEA_1_T6 | 23 |
| D56406_PEA_1_T7 | 24 |

TABLE 142

Segments of interest

| Segment Name | Sequence ID No. |
|---|---|
| D56406_PEA_1_node_0 | 340 |
| D56406_PEA_1_node_13 | 341 |
| D56406_PEA_1_node_11 | 342 |
| D56406_PEA_1_node_2 | 343 |
| D56406_PEA_1_node_3 | 344 |
| D56406_PEA_1_node_5 | 345 |
| D56406_PEA_1_node_6 | 346 |
| D56406_PEA_1_node_7 | 347 |
| D56406_PEA_1_node_8 | 348 |
| D56406_PEA_1_node_9 | 349 |

TABLE 143

Proteins of interest

| Protein Name | Sequence ID No. |
|---|---|
| D56406_PEA_1_P2 | 1301 |
| D56406_PEA_1_P5 | 1302 |
| D56406_PEA_1_P6 | 1303 |

These sequences are variants of the known protein Neurotensin/neuromedin N precursor [Contains: Large neuromedin N(NmN-125); Neuromedin N (NmN) (NN); Neurotensin (NT); Tail peptide] (SwissProt accession identifier NEUT_HUMAN), SEQ ID NO: 1422, referred to herein as the previously known protein.

Protein Neurotensin/neuromedin N precursor is known or believed to have the following function(s): Neurotensin may play an endocrine or paracrine role in the regulation of fat metabolism. It causes contraction of smooth muscle. The sequence for protein Neurotensin/neuromedin N precursor is given at the end of the application, as "Neurotensin/neuromedin N precursor [Contains: Large neuromedin N(NmN-125); Neuromedin N (NmN) (NN); Neurotensin (NT); Tail peptide] amino acid sequence". Protein Neurotensin/neuromedin N precursor localization is believed to be Secreted; Packaged within secretory vesicles.

The following GO Annotation(s) apply to the previously known protein. The following annotation(s) were found: signal transduction, which are annotation(s) related to Biological Process; neuropeptide hormone, which are annotation(s) related to Molecular Function; and extracellular; soluble fraction, which are annotation(s) related to Cellular Component.

The GO assignment relies on information from one or more of the SwissProt/TremBl Protein knowledgebase, available from <dot expasy dot ch/sprot/>; or Locuslink, available from <dot ncbinlmdot nih dot gov/projects/LocusLink/>.

As noted above, cluster D56406 features 3 transcript(s), which were listed in Table 141 above. These transcript(s) encode for protein(s) which are variant(s) of protein Neurotensin/neuromedin N precursor. A description of each variant protein according to the present invention is now provided.

Variant protein D56406_PEA_1_P2 (SEQ ID NO:1301) according to the present invention has an amino acid sequence as given at the end of the application; it is encoded by transcript(s) D56406_PEA_1_T3 (SEQ ID NO:22). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P2 (SEQ ID NO:1301) and NEUT_HUMAN (SEQ ID NO:1422):

1. An isolated chimeric polypeptide encoding for D56406_PEA_1_P2 (SEQ ID NO:1301), comprising a first amino acid sequence being at least 90% homologous to MMAGMKIQLVCMLLLAFSSWSLCSD-SEEEMKALEADFLTNMHTSKISKAH-VPSWKMTLLNVCSLVNNL NSPAEETGEVHEEELVA-RRKLPTALDGFSLEAMLTIYQLHKICHSRAFQHWE corresponding to amino acids 1-120 of NEUT_HUMAN (SEQ ID NO:1422), which also corresponds to amino acids 1-120 of D56406_PEA_1_P2 (SEQ ID NO:1301), second amino acid sequence being at least 70%, optionally at least 80%, preferably at least 85%, more preferably at least 90% and most preferably at least 95% homologous to a polypeptide having the sequence ARWLTPVIPALWEA-ETGGSRGQEMETIPANT (SEQ ID NO:1773) corresponding to amino acids 121-151 of D56406_PEA_1_P2 (SEQ ID NO:1301), and a third amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 152-201 of D56406_PEA_1_P2 (SEQ ID NO:1301), wherein said first, second and third amino acid sequences are contiguous and in a sequential order.

2. An isolated polypeptide encoding for an edge portion of D56406_PEA_1_P2 (SEQ ID NO:1301), comprising an amino acid sequence being at least 70%, optionally at least about 80%, preferably at least about 85%, more preferably at least about 90% and most preferably at least about 95% homologous to the sequence encoding for ARWLTPVIPAL-WEAETGGSRGQEMETIPANT (SEQ ID NO:1773), corresponding to D56406_PEA_1_P2 (SEQ ID NO:1301).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P2 (SEQ ID NO:1301) also has the following non-silent SNPs (Single Nucleotide Polymorphisms) as listed in Table 144, (given according to their position(s) on the amino acid sequence, with the alternative amino acid(s) listed; the last column indicates whether the SNP is known or not; the presence of known SNPs in variant protein D56406_PEA_1_P2 (SEQ ID NO:1301) sequence provides support for the deduced sequence of this variant protein according to the present invention).

TABLE 144

Amino acid mutations

| SNP position(s) on amino acid sequence | Alternative amino acid(s) | Previously known SNP? |
|---|---|---|
| 30 | M -> V | No |
| 44 | S -> P | No |
| 84 | V -> | No |
| 84 | V -> A | No |

Variant protein D56406_PEA_1_P2 (SEQ ID NO:1301) is encoded by the following transcript(s): D56406_PEA_1_T3 (SEQ ID NO:22), for which the sequence(s) is/are given at the end of the application. The coding portion of transcript D56406_PEA_1_T3 (SEQ ID NO:22) is shown in bold; this coding portion starts at position 106 and ends at position 708. The transcript also has the following SNPs as listed in Table 145 (given according to their position on the nucleotide sequence, with the alternative nucleic acid listed; the last column indicates whether the SNP is known or not; the presence of known SNPs in variant protein D56406_PEA_1_P2 (SEQ ID NO:1301) sequence provides support for the deduced sequence of this variant protein according to the present invention).

TABLE 145

Nucleic acid SNPs

| SNP position on nucleotide sequence | Alternative nucleic acid | Previously known SNP? |
|---|---|---|
| 94 | G -> T | No |
| 95 | A -> T | No |
| 858 | T -> G | Yes |
| 103 | A -> G | Yes |
| 193 | A -> G | No |
| 235 | T -> C | No |
| 339 | T -> C | No |
| 356 | T -> | No |
| 356 | T -> C | No |
| 417 | A -> T | No |
| 757 | T -> | No |

Variant protein D56406_PEA_1_P5 (SEQ ID NO:1302) according to the present invention has an amino acid sequence as given at the end of the application; it is encoded by transcript(s) D56406_PEA_1_T6 (SEQ ID NO:23). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P5 (SEQ ID NO:1302) and NEUT_HUMAN (SEQ ID NO:1422):

1. An isolated chimeric polypeptide encoding for D56406_PEA_1_P5 (SEQ ID NO:1302), comprising a first amino acid sequence being at least 90% homologous to MMAGMKIQLVCMLLLAFSSWSLC corresponding to amino acids 1-23 of NEUT_HUMAN (SEQ ID NO:1422), which also corresponds to amino acids 1-23 of D56406_PEA_1_P5 (SEQ ID NO:1302), and a second amino acid sequence being at least 90% homologous to SEEEMKALEADFLTNMHTSKISKAHVPSWKMTLLN-VCSLVNNLNSPAEETGEVHEEELVARRKLPTALDG FSLEAMLTIYQLHKICHSRAFQHWELIQEDILDT-GNDKNGKEEVKRKIPYILKRQLYENKPRRPYILKRDS YYY corresponding to amino acids 26-170 of NEUT_HUMAN (SEQ ID NO:1422), which also corresponds to amino acids 24-168 of D56406_PEA_1_P5 (SEQ ID NO:1302), wherein said first and second amino acid sequences are contiguous and in a sequential order.

2. An isolated chimeric polypeptide encoding for an edge portion of D56406_PEA_1_P5 (SEQ ID NO:1302), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise CS, having a structure as follows: a sequence starting from any of amino acid numbers 23-x to 23; and ending at any of amino acid numbers 24+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P5 (SEQ ID NO:1302) also has the following non-silent SNPs (Single Nucleotide Polymorphisms) as listed in Table 146, (given according to their position(s) on the amino acid sequence, with the alternative amino acid(s) listed; the last column indicates whether the SNP is known or not; the presence of known SNPs in variant protein D56406_PEA_1_P5 (SEQ ID NO:1302) sequence provides support for the deduced sequence of this variant protein according to the present invention).

TABLE 146

Amino acid mutations

| SNP position(s) on amino acid sequence | Alternative amino acid(s) | Previously known SNP? |
|---|---|---|
| 28 | M -> V | No |
| 42 | S -> P | No |
| 82 | V -> | No |
| 82 | V -> A | No |

Variant protein D56406_PEA_1_P5 (SEQ ID NO:1302) is encoded by the following transcript(s): D56406_PEA_1_T6 (SEQ ID NO:23), for which the sequence(s) is/are given at the end of the application. The coding portion of transcript D56406_PEA_1_T6 (SEQ ID NO:23) is shown in bold; this coding portion starts at position 106 and ends at position 609. The transcript also has the following SNPs as listed in Table 147 (given according to their position on the nucleotide sequence, with the alternative nucleic acid listed; the last column indicates whether the SNP is known or not; the presence of known SNPs in variant protein D56406_PEA_1_P5 (SEQ ID NO:1302) sequence provides support for the deduced sequence of this variant protein according to the present invention).

TABLE 147

Nucleic acid SNPs

| SNP position on nucleotide sequence | Alternative nucleic acid | Previously known SNP? |
|---|---|---|
| 94 | G -> T | No |
| 95 | A -> T | No |
| 759 | T -> G | Yes |
| 806 | G -> A | Yes |
| 1014 | T -> G | No |
| 1178 | T -> G | No |
| 103 | A -> G | Yes |
| 187 | A -> G | No |
| 229 | T -> C | No |
| 333 | T -> C | No |
| 350 | T -> | No |
| 350 | T -> C | No |
| 411 | A -> T | No |
| 658 | T -> | No |

Variant protein D56406_PEA_1_P6 (SEQ ID NO:1303) according to the present invention has an amino acid sequence as given at the end of the application; it is encoded by transcript(s) D56406_PEA_1_T7 (SEQ ID NO:24). An alignment is given to the known protein (Neurotensin/neuromedin N precursor) at the end of the application. One or more alignments to one or more previously published protein sequences are given at the end of the application. A brief description of the relationship of the variant protein according to the present invention to each such aligned protein is as follows:

Comparison report between D56406_PEA_1_P6 (SEQ ID NO:1303) and NEUT_HUMAN (SEQ ID NO:1422):

1. An isolated chimeric polypeptide encoding for D56406_PEA_1_P6 (SEQ ID NO:1303), comprising a first amino acid sequence being at least 90% homologous to MMAGMKIQLVCMLLLAFSSWSLCSD-SEEEMKALEADFLTNMHTSK corresponding to amino acids 1-45 of NEUT_HUMAN (SEQ ID NO:1422), which also corresponds to amino acids 1-45 of D56406_PEA_1_P6 (SEQ ID NO:1303), and a second amino acid sequence being at least 90% homologous to LIQEDILDTGNDKNGKEE-VIKRKIPYILKRQLYENKPRRPYILKRDSYYY corresponding to amino acids 121-170 of NEUT_HUMAN (SEQ ID NO:1422), which also corresponds to amino acids 46-95 of D56406_PEA_1_P6 (SEQ ID NO:1303), wherein said first and second amino acid sequences are contiguous and in a sequential order.

2. An isolated chimeric polypeptide encoding for an edge portion of D56406_PEA_1_P6 (SEQ ID NO:1303), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KL, having a structure as follows: a sequence starting from any of amino acid numbers 45-x to 45; and ending at any of amino acid numbers 46+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein D56406_PEA_1_P6 (SEQ ID NO:1303) also has the following non-silent SNPs (Single Nucleotide Polymorphisms) as listed in Table 148, (given according to their position(s) on the amino acid sequence, with the alternative amino acid(s) listed; the last column indicates whether the SNP is known or not; the presence of known SNPs in variant protein D56406_PEA_1_P6 (SEQ ID NO:1303) sequence provides support for the deduced sequence of this variant protein according to the present invention).

TABLE 148

Amino acid mutations

| SNP position(s) on amino acid sequence | Alternative amino acid(s) | Previously known SNP? |
|---|---|---|
| 30 | M -> V | No |
| 44 | S -> P | No |

Variant protein D56406_PEA_1_P6 (SEQ ID NO:1303) is encoded by the following transcript(s): D56406_PEA_1_T7 (SEQ ID NO:24), for which the sequence(s) is/are given at the end of the application. The coding portion of transcript D56406_PEA_1_T7 (SEQ ID NO:24) is shown in bold; this coding portion starts at position 106 and ends at position 390. The transcript also has the following SNPs as listed in Table 149 (given according to their position on the nucleotide sequence, with the alternative nucleic acid listed; the last column indicates whether the SNP is known or not; the presence of known SNPs in variant protein D56406_PEA_1_P6 (SEQ ID NO:1303) sequence provides support for the deduced sequence of this variant protein according to the present invention).

TABLE 149

Nucleic acid SNPs

| SNP position on nucleotide sequence | Alternative nucleic acid | Previously known SNP? |
|---|---|---|
| 94 | G -> T | No |
| 95 | A -> T | No |
| 103 | A -> T | Yes |
| 193 | A -> G | No |
| 235 | T -> C | No |
| 439 | T -> | No |
| 540 | T -> G | Yes |
| 587 | G -> A | Yes |
| 795 | T -> G | No |
| 959 | T -> G | No |

As noted above, cluster D56406 features 10 segment(s), which were listed in Table 142 above and for which the sequence(s) are given at the end of the application. These segment(s) are portions of nucleic acid sequence(s) which are described herein separately because they are of particular interest. A description of each segment according to the present invention is now provided.

Segment cluster D56406_PEA_1_node_0 (SEQ ID NO:1135) according to the present invention is supported by 48 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 150 below describes the starting and ending position of this segment on each transcript.

TABLE 150

Segment location on transcripts

| Transcript name | Segment starting position | Segment ending position |
|---|---|---|
| D56406_PEA_1_T3 (SEQ ID NO:22) | 1 | 178 |
| D56406_PEA_1_T6 (SEQ ID NO:23) | 1 | 178 |
| D56406_PEA_1_T7 (SEQ ID NO:24) | 1 | 178 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 151.

TABLE 151

Oligonucleotides related to this segment

| Oligonucleotide name | Overexpressed in cancers | Chip reference |
|---|---|---|
| D56406_0_5_0 (SEQ ID NO: 210) | lung malignant tumors | LUN |

Segment cluster D56406_PEA_1_node_13 (SEQ ID NO:1136) according to the present invention is supported by 43 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 152 below describes the starting and ending position of this segment on each transcript.

TABLE 152

Segment location on transcripts

| Transcript name | Segment starting position | Segment ending position |
|---|---|---|
| D56406_PEA_1_T3 (SEQ ID NO:22) | 559 | 902 |
| D56406_PEA_1_T6 (SEQ ID NO:23) | 460 | 1239 |
| D56406_PEA_1_T7 (SEQ ID NO:24) | 241 | 1020 |

According to an optional embodiment of the present invention, short segments related to the above cluster are also provided. These segments are up to about 120 bp in length, and so are included in a separate description.

Segment cluster D56406_PEA_1_node_11 (SEQ ID NO:1137) according to the present invention is supported by 1 libraries. The number of libraries was determined as previously described. This segment can be found in the following transcript(s): D56406_PEA_1_T3 (SEQ ID NO:22). Table 153 below describes the starting and ending position of this segment on each transcript.

TABLE 153

Segment location on transcripts

| Transcript name | Segment starting position | Segment ending position |
|---|---|---|
| D56406_PEA_1_T3 (SEQ ID NO:22) | 466 | 558 |

Segment cluster D56406_PEA_1_node_2 (SEQ ID NO:1138) according to the present invention can be found in the following transcript(s): D56406_PEA_1_T3 (SEQ ID NO:22) and D56406_PEA_1_T7 (SEQ ID NO:24). Table 154 below describes the starting and ending position of this segment on each transcript.

TABLE 154

Segment location on transcripts

| Transcript name | Segment starting position | Segment ending position |
|---|---|---|
| D56406_PEA_1_T3 (SEQ ID NO:22) | 179 | 184 |
| D56406_PEA_1_T7 (SEQ ID NO:24) | 179 | 184 |

Segment cluster D56406_PEA_1_node_3 (SEQ ID NO:1139) according to the present invention is supported by 46 libraries. The number of libraries was determined as previously described. This segment can be found in the following transcript(s): D56406_PEA_1_T3 (SEQ ID NO:22), D56406_PEA_1_T6 (SEQ ID NO:23) and D56406_PEA_1_T7 (SEQ ID NO:24). Table 155 below describes the starting and ending position of this segment on each transcript.

TABLE 155

Segment location on transcripts

| Transcript name | Segment starting position | Segment ending position |
|---|---|---|
| D56406_PEA_1_T3 (SEQ ID NO:22) | 185 | 240 |
| D56406_PEA_1_T6 (SEQ ID NO:23) | 179 | 234 |
| D56406_PEA_1_T7 (SEQ ID NO:24) | 185 | 240 |

Segment cluster D56406_PEA_1_node_5 (SEQ ID NO:1140) according to the present invention is supported by 48 libraries. The number of libraries was determined as previously described. This segment can be found in the following transcript(s): D56406_PEA_1_T3 (SEQ ID NO:22) and D56406_PEA_1_T6 (SEQ ID NO:23). Table 156 below describes the starting and ending position of this segment on each transcript.

TABLE 156

Segment location on transcripts

| Transcript name | Segment starting position | Segment ending position |
|---|---|---|
| D56406_PEA_1_T3 (SEQ ID NO:22) | 241 | 355 |

TABLE 156-continued

Segment location on transcripts

| Transcript name | Segment starting position | Segment ending position |
| --- | --- | --- |
| D56406_PEA_1_T6 (SEQ ID NO:23) | 235 | 349 |

Segment cluster D56406_PEA_1_node_6 (SEQ ID NO:1141) according to the present invention is supported by 34 libraries. The number of libraries was determined as previously described. This segment can be found in the following transcript(s): D56406_PEA_1_T3 (SEQ ID NO:22) and D56406_PEA_1_T6 (SEQ ID NO:23). Table 157 below describes the starting and ending position of this segment on each transcript.

TABLE 157

Segment location on transcripts

| Transcript name | Segment starting position | Segment ending position |
| --- | --- | --- |
| D56406_PEA_1_T3 (SEQ ID NO:22) | 356 | 389 |
| D56406_PEA_1_T6 (SEQ ID NO:23) | 350 | 383 |

Segment cluster D56406_PEA_1_node_7 (SEQ ID NO:1142) according to the present invention is supported by 32 libraries. The number of libraries was determined as previously described. This segment can be found in the following transcript(s): D56406_PEA_1_T3 (SEQ ID NO:22) and D56406_PEA_1_T6 (SEQ ID NO:23). Table 158 below describes the starting and ending position of this segment on each transcript.

TABLE 158

Segment location on transcripts

| Transcript name | Segment starting position | Segment ending position |
| --- | --- | --- |
| D56406_PEA_1_T3 (SEQ ID NO:22) | 390 | 415 |
| D56406_PEA_1_T6 (SEQ ID NO:23) | 384 | 409 |

Segment cluster D56406_PEA_1_node_8 (SEQ ID NO:1143) according to the present invention can be found in the following transcript(s): D56406_PEA_1_T3 (SEQ ID NO:22) and D56406_PEA_1_T6 (SEQ ID NO:23). Table 159 below describes the starting and ending position of this segment on each transcript.

TABLE 159

Segment location on transcripts

| Transcript name | Segment starting position | Segment ending position |
| --- | --- | --- |
| D56406_PEA_1_T3 (SEQ ID NO:22) | 416 | 423 |
| D56406_PEA_1_T6 (SEQ ID NO:23) | 410 | 417 |

Segment cluster D56406_PEA_1_node_9 (SEQ ID NO:1144) according to the present invention is supported by 31 libraries. The number of libraries was determined as previously described. This segment can be found in the following transcript(s): D56406_PEA_1_T3 (SEQ ID NO:22) and D56406_PEA_1_T6 (SEQ ID NO:23). Table 160 below describes the starting and ending position of this segment on each transcript.

TABLE 160

Segment location on transcripts

| Transcript name | Segment starting position | Segment ending position |
| --- | --- | --- |
| D56406_PEA_1_T3 (SEQ ID NO:22) | 424 | 465 |
| D56406_PEA_1_T6 (SEQ ID NO:23) | 418 | 459 |

Variant protein alignment to the previously known protein:

Sequence name: /tmp/jU49325aMA/8F0XuN7La5:NEUT_HUMAN (SEQ ID NO:1422)

Sequence documentation:

Alignment of: D56406_PEA_1_P2 (SEQ ID NO:1301) x NEUT_HUMAN (SEQ ID NO:1422)

Alignment segment 1/1:

| | |
| --- | --- |
| Quality: 1591.00 | Escore: 0 |
| Matching length: 170 | Total length: 201 |
| Matching Percent Similarity: 100.00 | Matching Percent Identity: 100.00 |
| Total Percent Similarity: 84.58 | Total Percent Identity: 84.58 |
| Gaps: 1 | |

Alignment:

```
  1 MMAGMKIQLVCMLLLAFSSWSLCSDSEEEMKALEADFLTNMHTSKISKAH  50
    ||||||||||||||||||||||||||||||||||||||||||||||||||
  1 MMAGMKIQLVCMLLLAFSSWSLCSDSEEEMKALEADFLTNMHTSKISKAH  50

51 VPSWKMTLLNVCSLVNNLNSPAEETGEVHEEELVARRKLPTALDGFSLEA 100
    ||||||||||||||||||||||||||||||||||||||||||||||||||
 51 VPSWKMTLLNVCSLVNNLNSPAEETGEVHEEELVARRKLPTALDGFSLEA 100

101 MLTIYQLHKICHSRAFQHWEARWLTPVIPALWEAETGGSRGQEMETIPAN 150
    |||||||||||||||||||
101 MLTIYQLHKICHSRAFQHWE.............................. 120
```

```
151 TLIQEDILDTGNDKNGKEEVIKRKIPYILKRQLYENKPRRPYILKRDSYY 200
    |||||||||||||||||||||||||||||||||||||||||||||||||
121 .LIQEDILDTGNDKNGKEEVIKRKIPYILKRQLYENKPRRPYILKRDSYY 169

201 Y
    |
170 Y
```

Sequence name: /tmp/wWui8 Kd4y9/zbf3ihRwnR:NEU-T_HUMAN (SEQ ID NO:1422)

Sequence documentation:

Alignment of: D56406_PEA_1_P5 (SEQ ID NO:1302) x NEUT_HUMAN (SEQ ID NO:1422)

Alignment segment 1/1:

| | |
|---|---|
| Quality: 1572.00 | Escore: 0 |
| Matching length: 168 | Total length: 170 |
| Matching Percent Similarity: 100.00 | Matching Percent Identity: 100.00 |
| Total Percent Similarity: 98.82 | Total Percent Identity: 98.82 |
| Gaps: 1 | |

Sequence name: /tmp/f5d07fF5D7/E4N5xjUIAN:NEU-T_HUMAN (SEQ ID NO:1422)

Sequence documentation:

Alignment of: D56406_PEA_1_P6 (SEQ ID NO:1303) x NEUT_HUMAN (SEQ ID NO:1422)

Alignment segment 1/1:

| | |
|---|---|
| Quality: 844.00 | Escore: 0 |
| Matching length: 95 | Total length: 170 |
| Matching Percent Similarity: 100.00 | Matching Percent Identity: 100.00 |
| Total Percent Similarity: 55.88 | Total Percent Identity: 55.88 |
| Gaps: 1 | |

Alignment:

```
  1 MMAGMKIQLVCMLLLAFSSWSLC..SEEEMKALEADFLTNMHTSKISKAH  48
    ||||||||||||||||||||||  ||||||||||||||||||||||||||
  1 MMAGMKIQLVCMLLLAFSSWSLCSDSEEEMKALEADFLTNMHTSKISKAH  50

49 VPSWKMTLLNVCSLVNNLNSPAEETGEVHEEELVARRKLPTALDGFSLEA  98
    ||||||||||||||||||||||||||||||||||||||||||||||||||
 51 VPSWKMTLLNVCSLVNNLNSPAEETGEVHEEELVARRKLPTALDGFSLEA 100

99 MLTIYQLHKICHSRAFQHWELIQEDILDTGNDKNGKEEVIKRKIPYILKR 148
    ||||||||||||||||||||||||||||||||||||||||||||||||||
101 MLTIYQLHKICHSRAFQHWELIQEDILDTGNDKNGKEEVIKRKIPYILKR 150

149 QLYENKPRRPYILKRDSYYY                               168
    ||||||||||||||||||||
151 QLYENKPRRPYILKRDSYYY                               170
```

Alignment:

```
  1 MMAGMKIQLVCMLLLAFSSWSLCSDSEEEMKALEADFLTNMHTSK.....  45
    ||||||||||||||||||||||||||||||||||||||||||||
  1 MMAGMKIQLVCMLLLAFSSWSLCSDSEEEMKALEADFLTNMHTSKISKAH  45

45 ................................................  45
 51 VPSWKMTLLNVCSLVNNLNSPAEETGEVHEEELVARRKLPTALDGFSLEA 100

45 ....................LIQEDILDTGNDKNGKEEVIKRKIPYILKR  75
                        ||||||||||||||||||||||||||||||
101 MLTIYQLHKICHSRAFQHWELIQEDILDTGNDKNGKEEVIKRKIPYILKR 150

76 QLYENKPRRPYILKRDSYYY                                95
    ||||||||||||||||||||
101 QLYENKPRRPYILKRDSYYY                               170
```

Expression of NTS D56406 Transcripts which are Detectable by Amplicon as Depicted in Sequence Name D56406_seg7-9F2R2 (SEQ ID NO:1798) in Normal and cancerous Lung Tissues Expression of NTS transcripts detectable by or according to seg7-9F2R2— D56406_seg7-9F2R2 amplicon (SEQ ID NO: 1798) and primers D56406_seg7-9F2 (SEQ ID NO: 1796) and D56406_seg7-9R2 (SEQ ID NO: 1797) was measured by real time PCR. In parallel the expression of several housekeeping genes—HPRT1 (GenBank Accession No. NM_000194 (SEQ ID NO: 1714); amplicon—HPRT1-amplicon (SEQ ID NO: 1297)), PBGD (GenBank Accession No. BC019323 (SEQ ID NO: 1713); amplicon—PBGD-amplicon (SEQ ID NO: 334)), SDHA (GenBank Accession No. NM_004168 (SEQ ID NO: 1712); amplicon—SDHA-amplicon (SEQ ID NO: 331)) and Ubiquitin (GenBank Accession No. BC000449 (SEQ ID NO: 1711); amplicon—Ubiquitin-amplicon (SEQ ID NO: 328)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the normal samples (sample numbers 51-64, 69 and 70, Table 2_1 above), to obtain a value of fold up-regulation for each sample relative to median of the normal samples.

Figure 112:
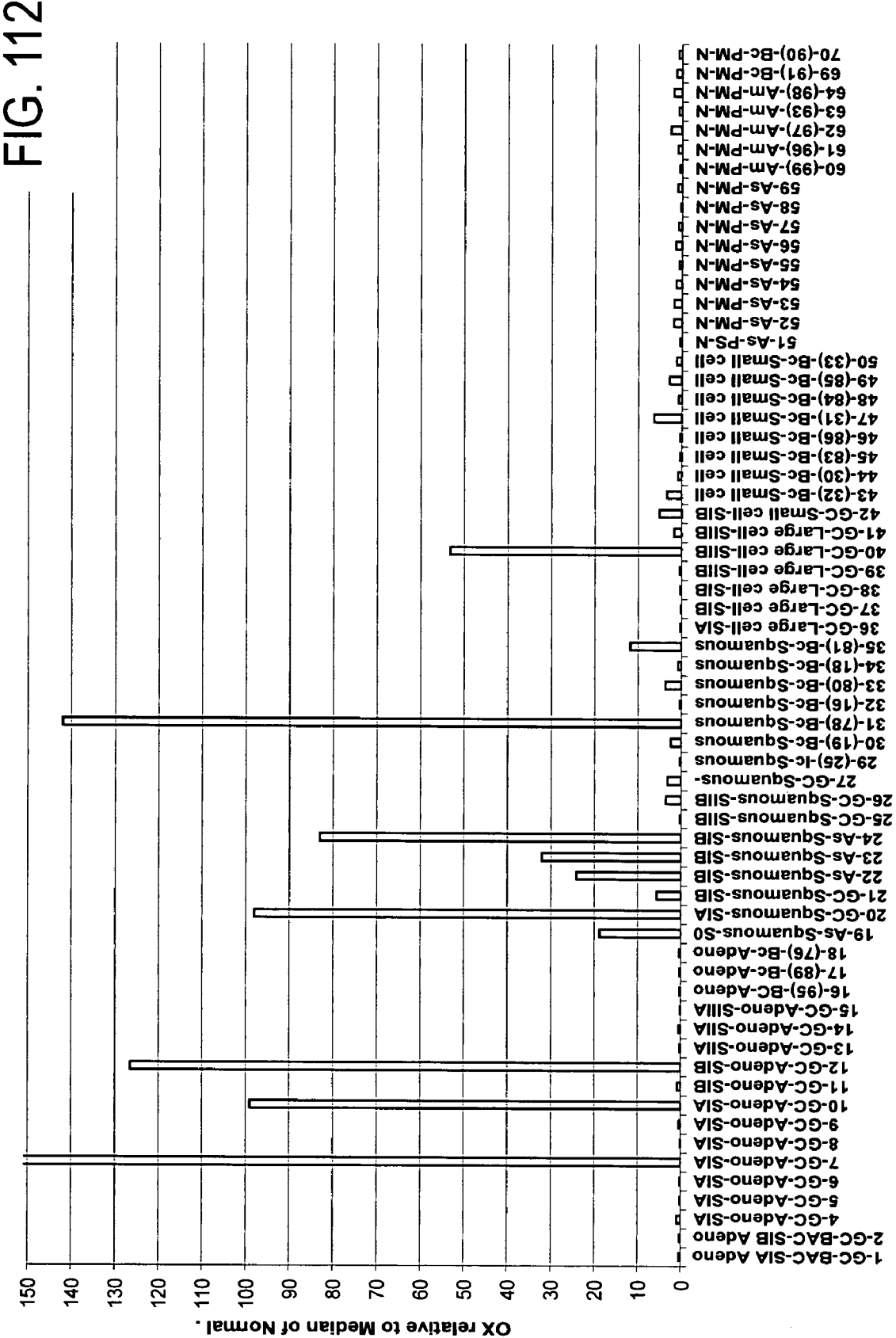
FIG. 112 is a histogram showing the expression of NTS D56406 transcripts which are detectable by amplicon as depicted in sequence name D56406_seg7-9F2R2 in normal and cancerous Lung tissues.

FIG. 112 is a histogram showing over expression of the above-indicated NTS transcripts in cancerous Lung samples relative to the normal samples.

As is evident from FIG. 112, the expression of NTS transcripts detectable by the above amplicon in non-small cell carcinoma samples, specifically in squamous cell carcinoma was significantly higher than in the non-cancerous samples (sample numbers 51-64, 69 and 70, Table 2_1 above). Notably an over-expression of at least 5 fold was found in 12 out of 39 non-small cell carcinoma samples and in 8 out of 16 squamous cell carcinoma samples.

Statistical analysis was applied to verify the significance of these results, as described below.

The P value for the difference in the expression levels of NTS transcripts detectable by the above amplicon in Lung non-small cell carcinoma samples versus the normal tissue samples was determined by T test as 1.47e-002. The P value for the difference in the expression levels of NTS transcripts detectable by the above amplicon in Lung squamous cell carcinoma samples versus the normal tissue samples was determined by T test as 1.46e-002.

Threshold of 5 fold over expression was found to differentiate between non-small cell carcinoma and normal samples with P value of 8.91e-003 as checked by exact Fisher test. Threshold of 5 fold over expression was found to differentiate between squamous cell carcinoma and normal samples with P value of 1.22e-003 as checked by exact Fisher test.

The above values demonstrate statistical significance of the results.

Primer pairs are also optionally and preferably encompassed within the present invention; for example, for the above experiment, the following primer pair was used as a non-limiting illustrative example only of a suitable primer pair: D56406_seg7-9F2 forward primer (SEQ ID NO: 1796); and D56406_seg7-9R2 reverse primer (SEQ ID NO: 1797).

The present invention also preferably encompasses any amplicon obtained through the use of any suitable primer pair; for example, for the above experiment, the following amplicon was obtained as a non-limiting illustrative example only of a suitable amplicon: D56406_seg7-9F2R2 (SEQ ID NO:1798).

Forward Primer (D56406_seg7-9F2 (SEQ ID NO:1796)): AGCTCCACAAAATCTGTCACAGC

Reverse Primer (D56406_seg7-9R2 (SEQ ID NO:1797)): TGATCCGCCCGTCTCG

Amplicon (D56406_seg7-9F2R2 (SEQ ID NO:1798)): AGCTCCACAAAATCTGTCACAG-CAGGGCTTTTCAACACTGGGAGGCACG-GTGGCTCACGCCTGTAATCCCA GCACTTTGGGAG-GCCGAGACGGGCGGATCA Expression of NTS D56406 Transcripts which are Detectable by Amplicon as Depicted in Sequence Name D56406 seg7-9F2R2 (SEQ ID NO:1798) in Different Normal Tissues Expression of NTS transcripts detectable by or according to seg7-9F2R2— D56406_seg7-9F2R2 amplicon (SEQ ID NO: 1798) and primers D56406_seg7-9F2 (SEQ ID NO: 1796) and D56406_seg7-9R2 (SEQ ID NO: 1797) was measured by real time PCR. In parallel the expression of several housekeeping genes—SDHA (GenBank Accession No. NM_004168 (SEQ ID NO: 1712); amplicon—SDHA-amplicon (SEQ ID NO: 331)), Ubiquitin (GenBank Accession No. BC000449 (SEQ ID NO: 1711); amplicon—Ubiquitin-amplicon (SEQ ID NO: 328)), RPL19 (GenBank Accession No. NM_000981 (SEQ ID NO: 1715); RPL19 amplicon (SEQ ID NO: 1630)) and TATA box (GenBank Accession No. NM_003194 (SEQ ID NO: 1716); TATA amplicon (SEQ ID NO: 1633)) was measured similarly. For each RT sample, the expression of the above amplicon was normalized to the normalization factor calculated from the expression of these house keeping genes as described in normalization method 2 in the "materials and methods" section. The normalized quantity of each RT sample was then divided by the median of the quantities of the lung samples (sample numbers 28, 29 and 30, Table 3_1 above), to obtain a value of relative expression of each sample relative to median of the lung samples.

Forward Primer (D56406_seg7-9F2) (SEQ ID NO:1796): AGCTCCACAAAATCTGTCACAGC

Reverse Primer (D56406_seg7-9R2) (SEQ ID NO:1797): TGATCCGCCCGTCTCG

Figure 113:
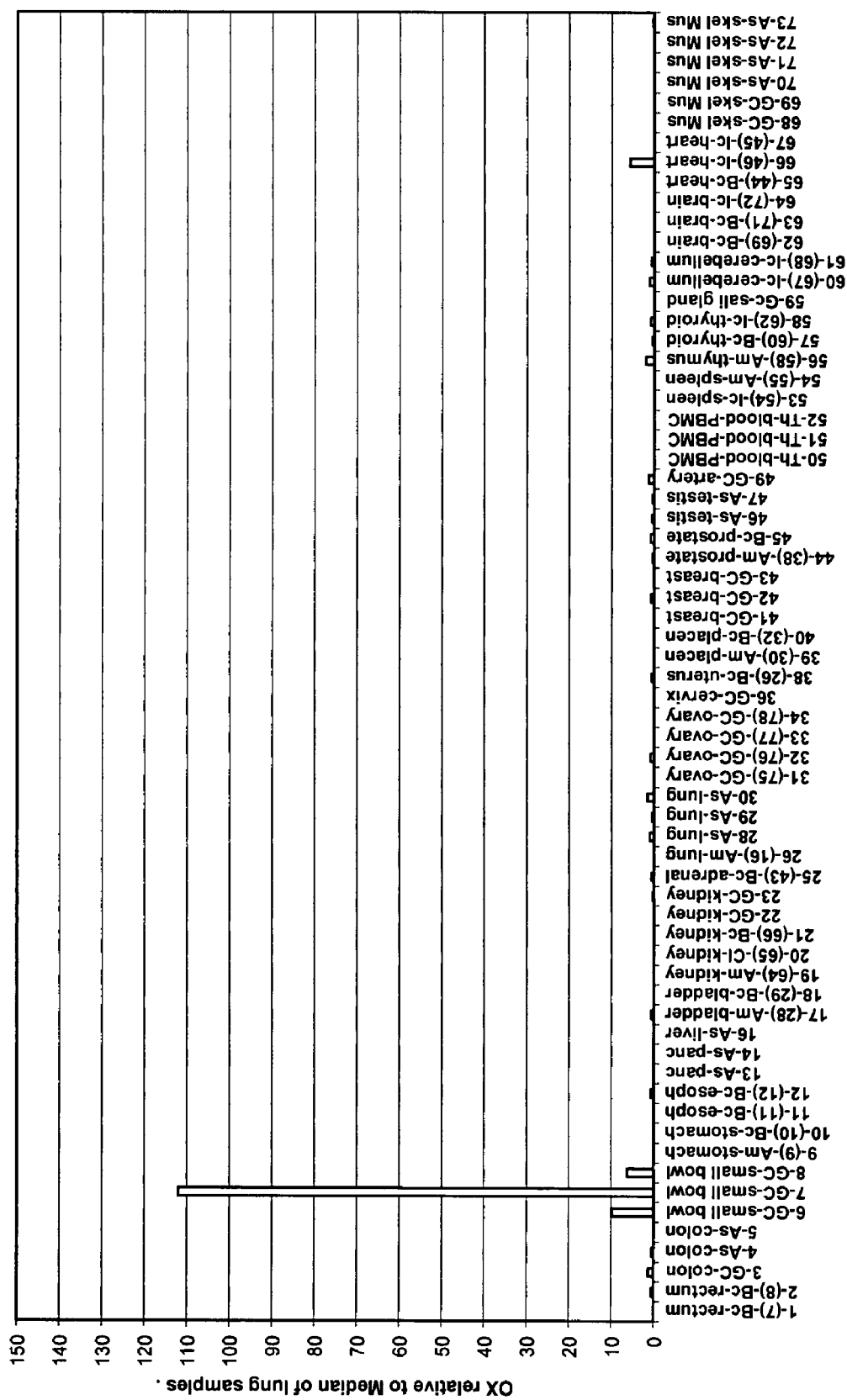
FIG. 113 is a histogram showing the expression of NTS D56406 transcripts which are detectable by amplicon as depicted in sequence name D56406_seg7-9F2R2 in different normal tissues.

Amplicon (D56406_seg7-9F2R2) (SEQ ID NO:1798):
AGCTCCACAAAATCTGTCACAG-CAGGGCTTTTCAACACTGGGAGGCACG-GTGGCTCACGCCTGTAATCCCA GCACTTTGGGAG-GCCGAGACGGGCGGATCA FIG. 113 shows a histogram showing the expression of NTS D56406 transcripts which are detectable by amplicon as depicted in sequence name D56406_seg7-9F2R2 (SEQ ID NO:1798) in different normal tissues.

Description for Cluster F05068

Cluster F05068 features 3 transcript(s) and 12 segment(s) of interest, the names for which are given in Tables 161 and 162, respectively, the sequences themselves are given at the end of the application. The selected protein variants are given in table 163.

TABLE 161

Transcripts of interest

| Transcript Name | Sequence ID No. |
|---|---|
| F05068_PEA_1_T3 | 25 |
| F05068_PEA_1_T4 | 26 |
| F05068_PEA_1_T6 | 27 |

TABLE 162

Segments of interest

| Transcript Name | Sequence ID No. |
|---|---|
| F05068_PEA_1_node_0 | 350 |
| F05068_PEA_1_node_10 | 351 |
| F05068_PEA_1_node_12 | 352 |
| F05068_PEA_1_node_13 | 353 |
| F05068_PEA_1_node_4 | 354 |
| F05068_PEA_1_node_8 | 355 |
| F05068_PEA_1_node_11 | 356 |
| F05068_PEA_1_node_3 | 357 |
| F05068_PEA_1_node_5 | 358 |
| F05068_PEA_1_node_6 | 359 |
| F05068_PEA_1_node_7 | 360 |
| F05068_PEA_1_node_9 | 361 |

TABLE 163

Proteins of interest

| Transcript Name | Sequence ID No. |
|---|---|
| F05068_PEA_1_P7 | 1304 |
| F05068_PEA_1_P8 | 1305 |

These sequences are variants of the known protein ADM precursor [Contains: Adrenomedullin (AM); Proadrenomedullin N-20 terminal peptide (ProAM-N20) (ProAM N-terminal 20 peptide) (PAMP)] (SwissProt accession identifier ADML_HUMAN), SEQ ID NO:1423, referred to herein as the previously known protein.

Protein ADM precursor is known or believed to have the following function(s): AM and PAMP are potent hypotensive and vasodilatator agents. Numerous actions have been reported, most related to the physiologic control of fluid and electrolyte homeostasis. In the kidney, AM is diuretic and natriuretic, and both AM and PAMP inhibit aldosterone secretion by direct adrenal actions. In pituitary gland, both peptides at physiologically relevant doses inhibit basal ACTH secretion. Both peptides appear to act in brain and pituitary gland to facilitate the loss of plasma volume, actions which complement their hypotensive effects in blood vessels. The sequence for protein ADM precursor is given at the end of the application, as "ADM precursor [Contains: Adrenomedullin (AM); Proadrenomedullin N-20 terminal peptide (ProAM-N20) (ProAM N-terminal 20 peptide) (PAMP)] amino acid sequence". Known polymorphisms for this sequence are as shown in Table 164.

TABLE 164

Amino acid mutations for Known Protein

| SNP position(s) on amine acid sequence | Comment |
|---|---|
| 50 | S -> R (in.dbSNP:5005)./FTId = VAR_014861. |

Protein ADM precursor localization is believed to be Secreted.

The following GO Annotation(s) apply to the previously known protein. The following annotation(s) were found: cAMP biosynthesis; progesterone biosynthesis; signal transduction; cell-cell signaling; pregnancy; excretion; circulation; response to wounding, which are annotation(s) related to Biological Process; ligand; hormone, which are annotation(s) related to Molecular Function; and extracellular space; soluble fraction, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster F05068 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 21 refer to weighted expression of ESTs in each category, as "parts per million" (ratio of the expression of ESTs for a particular cluster to the expression of all ESTs in that category, according to parts per million).

Figure 21:
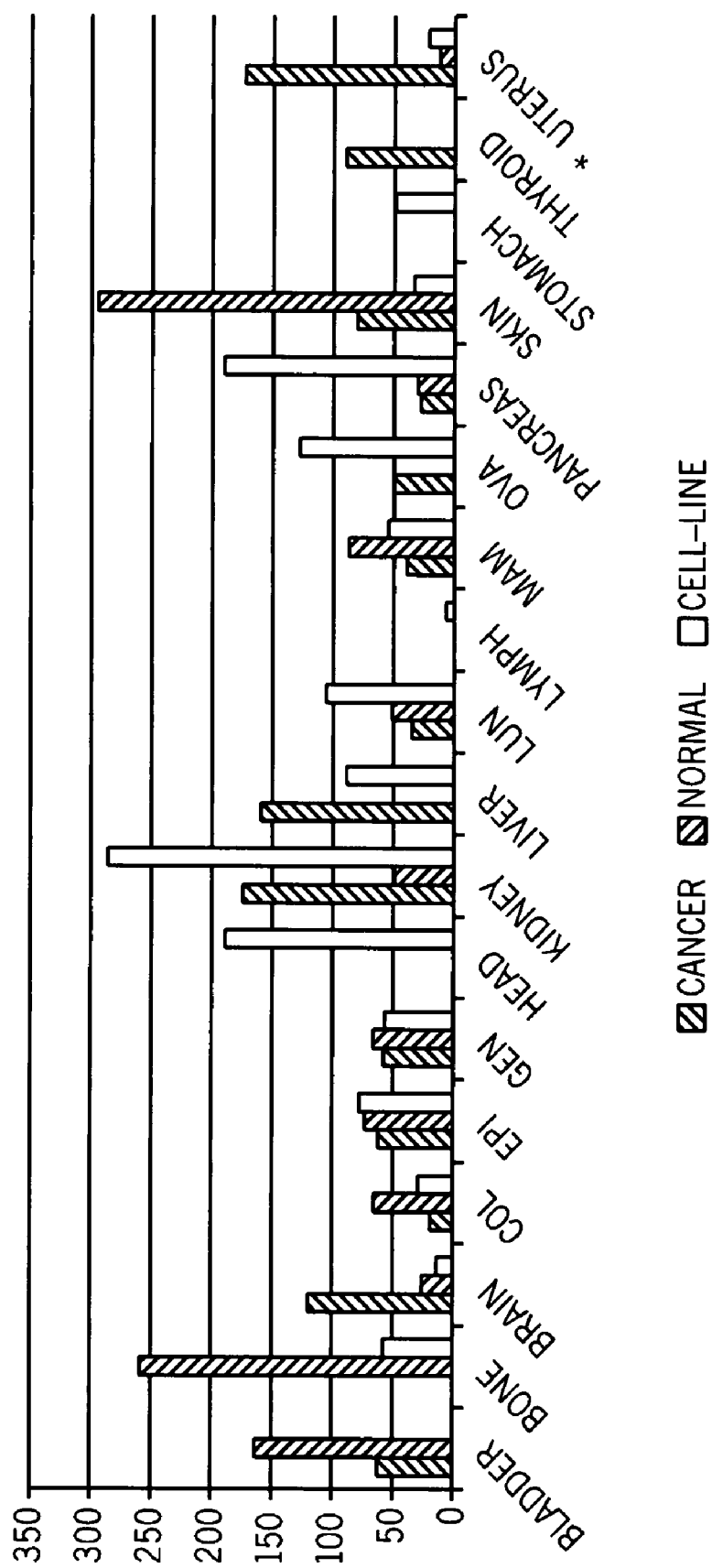
FIG. 21 is a histogram showing Cancer and cell-line vs. normal tissue expression for Cluster F05068, demonstrating overexpression in uterine malignancies.

Overall, the following results were obtained as shown with regard to the histograms in FIG. 21 and Table 165. This cluster is overexpressed (at least at a minimum level) in the following pathological conditions: uterine malignancies.

TABLE 165

Normal tissue distribution

| Name of Tissue | Number |
|---|---|
| bladder | 164 |
| bone | 259 |
| brain | 26 |
| colon | 66 |
| epithelial | 73 |
| general | 67 |
| head and neck | 0 |
| kidney | 49 |
| liver | 0 |
| lung | 51 |
| lymph nodes | 0 |
| breast | 87 |
| ovary | 0 |
| pancreas | 30 |
| skin | 295 |
| stomach | 0 |
| Thyroid | 0 |
| uterus | 13 |

TABLE 166

P values and ratios for expression in cancerous tissue.

| Name of Tissue | P1 | P2 | SP1 | R3 | SP2 | R4 |
|---|---|---|---|---|---|---|
| bladder | 7.6e−01 | 8.0e−01 | 9.4e−01 | 0.5 | 9.9e−01 | 0.4 |
| bone | 7.5e−01 | 8.8e−01 | 1 | 0.1 | 1 | 0.3 |
| brain | 5.2e−01 | 6.1e−01 | 7.0e−04 | 2.1 | 1.1e−02 | 1.4 |
| colon | 6.2e−01 | 6.1e−01 | 9.7e−01 | 0.5 | 9.6e−01 | 0.6 |
| epithelial | 1.0e−01 | 3.0e−02 | 7.8e−01 | 0.7 | 5.8e−01 | 0.9 |
| general | 3.7e−01 | 2.6e−01 | 8.5e−01 | 0.8 | 9.0e−01 | 0.8 |
| head and neck | 2.1e−01 | 1.1e−01 | 1 | 1.0 | 3.2e−01 | 2.3 |
| kidney | 3.8e−01 | 3.9e−01 | 6.6e−02 | 1.8 | 1.2e−02 | 2.2 |
| liver | 1.8e−01 | 1.2e−01 | 2.3e−01 | 4.3 | 2.3e−01 | 2.6 |
| lung | 6.2e−01 | 4.3e−01 | 8.5e−01 | 0.7 | 3.8e−01 | 1.0 |
| lymph nodes | 1 | 3.1e−01 | 1 | 1.0 | 1 | 1.3 |
| breast | 7.8e−01 | 5.8e−01 | 9.1e−01 | 0.6 | 8.9e−01 | 0.7 |
| ovary | 3.8e−01 | 2.6e−01 | 3.2e−01 | 2.4 | 1.6e−01 | 2.5 |
| pancreas | 5.1e−01 | 3.3e−01 | 7.0e−01 | 0.9 | 1.0e−01 | 1.4 |
| skin | 6.0e−01 | 5.2e−01 | 9.7e−01 | 0.3 | 1 | 0.1 |
| stomach | 3.6e−01 | 3.0e−01 | 1 | 1.0 | 4.1e−01 | 1.8 |
| Thyroid | 5.0e−01 | 5.0e−01 | 6.7e−01 | 1.7 | 6.7e−01 | 1.7 |
| uterus | 1.1e−01 | 2.6e−01 | 2.1e−03 | 3.2 | 2.3e−02 | 2.2 |

As noted above, cluster F05068 features 3 transcript(s), which were listed in Table 161 above. These transcript(s) encode for protein(s) which are variant(s) of protein ADM precursor. A description of each variant protein according to the present invention is now provided.

Variant protein F05068_PEA_1_P7 (SEQ ID NO:1304) according to the present invention has an amino acid sequence as given at the end of the application; it is encoded by transcript(s) F05068_PEA_1_T3 (SEQ ID NO:25) and F05068_PEA_1_T6 (SEQ ID NO:27). An alignment is given to the known protein (ADM precursor) at the end of the application. One or more alignments to one or more previously published protein sequences are given at the end of the application. A brief description of the relationship of the variant protein according to the present invention to each such aligned protein is as follows:

Comparison report between F05068_PEA_1_P7 (SEQ ID NO:1304) and ADML_HUMAN (SEQ ID NO:1423):

1. An isolated chimeric polypeptide encoding for F05068_PEA_1_P7 (SEQ ID NO:1304), comprising a first amino acid sequence being at least 90% homologous to MKLVSVALMYLGSLAFLGADTARLDVASEFRKK corresponding to amino acids 1-33 of ADML_HUMAN (SEQ ID NO:1423), which also corresponds to amino acids 1-33 of F05068_PEA_1_P7 (SEQ ID NO:1304).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein F05068_PEA_1_P7 (SEQ ID NO:1304) also has the following non-silent SNPs (Single Nucleotide Polymorphisms) as listed in Table 167, (given according to their position(s) on the amino acid sequence, with the alternative amino acid(s) listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 16

Amino acid mutations

| SNP position(s) on amino acid sequence | Alternative amino acid(s) | Previously known SNP? |
|---|---|---|
| 4 | V –> F | No |
| 10 | Y –> C | No |

Variant protein F05068_PEA_1_P7 (SEQ ID NO:1304) is encoded by the following transcript(s): F05068_PEA_1_T3 (SEQ ID NO:25) and F05068_PEA_1_T6 (SEQ ID NO:27), for which the sequence(s) is/are given at the end of the application.

The coding portion of transcript F05068_PEA_1_T3 (SEQ ID NO:25) is shown in bold; this coding portion starts at position 267 and ends at position 365. The transcript also has the following SNPs as listed in Table 168 (given according to their position on the nucleotide sequence, with the alternative nucleic acid listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 168

Nucleic acid SNPs

| SNP position(s) on nucleotide sequence | Alternative nucleic acid | Previously known SNP? |
|---|---|---|
| 860 | C –> | No |
| 860 | C –> A | No |
| 1022 | G –> A | No |
| 1023 | G –> A | No |
| 1023 | G –> C | Yes |
| 1084 | G –> A | Yes |
| 1088 | C –> | No |
| 1088 | C –> A | No |
| 1106 | C –> | No |
| 177 | T –> | No |
| 1106 | C –> A | No |
| 1149 | G –> | No |
| 1154 | C –> | No |
| 1171 | T –> G | Yes |
| 1192 | G –> | No |
| 1224 | C –> | No |
| 1266 | C –> | No |
| 1282 | C –> T | No |
| 1381 | G –> A | No |
| 1450 | T –> | No |
| 206 | C –> T | Yes |
| 1457 | T –> G | No |
| 1534 | C –> | No |
| 1535 | C –> | No |
| 1554 | A –> G | Yes |
| 1572 | A –> C | No |
| 1572 | A –> G | No |
| 1655 | A –> C | Yes |
| 1669 | T –> C | Yes |
| 1721 | C –> T | No |
| 245 | G –> | No |
| 259 | C –> | No |
| 276 | G –> T | No |
| 295 | A –> G | No |
| 317 | A –> C | Yes |
| 566 | C –> G | Yes |

The coding portion of transcript F05068_PEA_1_T6 (SEQ ID NO:27) is shown in bold; this coding portion starts at position 267 and ends at position 365. The transcript also has the following SNPs as listed in Table 169 (given according to their position on the nucleotide sequence, with the alternative nucleic acid listed; the last column indicates whether the SNP is known or not; the presence of known SNPs in variant protein F05068_PEA_1_P7 (SEQ ID NO:1304) sequence provides support for the deduced sequence of this variant protein according to the present invention).

TABLE 169

Nucleic acid SNPs

| SNP position on nucleotide sequence | Alternative nucleic acid | Previously known SNP? |
|---|---|---|
| 26 | C -> T | Yes |
| 164 | T -> | No |
| 593 | G -> C | Yes |
| 739 | G -> G | Yes |
| 1093 | C -> | No |
| 1093 | C -> A | No |
| 1255 | G -> A | No |
| 1256 | G -> A | No |
| 1256 | G -> C | Yes |
| 1317 | G -> A | Yes |
| 1321 | C -> | No |
| 1321 | C -> A | No |
| 177 | T -> | No |
| 1339 | C -> | No |
| 1339 | C -> A | No |
| 1382 | G -> | No |
| 1387 | C -> | No |
| 1404 | T -> G | Yes |
| 1425 | G -> | No |
| 1457 | C -> | No |
| 1499 | C -> | No |
| 1515 | C -> T | No |
| 1614 | G -> A | No |
| 206 | C -> T | Yes |
| 1683 | T -> | No |
| 1690 | T -> G | No |
| 1767 | C -> | No |
| 1768 | C -> | No |
| 1787 | A -> G | Yes |
| 1805 | A -> C | No |
| 1805 | A -> G | No |
| 1888 | A -> C | Yes |
| 1902 | T -> C | Yes |
| 1954 | C -> T | No |
| 245 | G -> | No |
| 259 | C -> | No |
| 276 | G -> T | No |
| 295 | A -> G | No |
| 317 | A -> C | Yes |
| 566 | C -> G | Yes |

Variant protein F05068_PEA_1_P8 (SEQ ID NO:1305) according to the present invention has an amino acid sequence as given at the end of the application; it is encoded by transcript(s) F05068_PEA_1_T4 (SEQ ID NO:26). An alignment is given to the known protein (ADM precursor) at the end of the application. One or more alignments to one or more previously published protein sequences are given at the end of the application. A brief description of the relationship of the variant protein according to the present invention to each such aligned protein is as follows:

Comparison report between F05068_PEA_1_P8 (SEQ ID NO:1305) and ADML_HUMAN (SEQ ID NO:1423):

1. An isolated chimeric polypeptide encoding for F05068_PEA_1_P8 (SEQ ID NO:1305), comprising a first amino acid sequence being at least 90% homologous to MKLVSVALMYLGSLAFLGADTARLD-VASEFRKKWNKWALSRGKREL-RMSSSYPTGLADVKAGPAQTLI RPQDMKGASRSPED corresponding to amino acids 1-82 of ADML_HUMAN (SEQ ID NO:1423), which also corresponds to amino acids 1-82 of F05068_PEA_1_P8 (SEQ ID NO:1305), and a second amino acid sequence being at least 70%, optionally at least 80%, preferably at least 85%, more preferably at least 90% and most preferably at least 95% homologous to a polypeptide having the sequence R corresponding to amino acids 83-83 of F05068_PEA_1_P8 (SEQ ID NO:1305), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein F05068_PEA_1_P8 (SEQ ID NO:1305) also has the following non-silent SNPs (Single Nucleotide Polymorphisms) as listed in Table 170, (given according to their position(s) on the amino acid sequence, with the alternative amino acid(s) listed; the last column indicates whether the SNP is known or not; the presence of known SNPs in variant protein F05068_PEA_1_P8 (SEQ ID NO:1305) sequence provides support for the deduced sequence of this variant protein according to the present invention).

TABLE 170

Amino acid mutations

| SNP position(s) on amino acid sequence | Alternative amino acid(s) | Previously known SNP? |
|---|---|---|
| 4 | V -> F | No |
| 50 | S -> R | Yes |
| 10 | Y -> C | No |

Variant protein F05068_PEA_1_P8 (SEQ ID NO:1305) is encoded by the following transcript(s): F05068_PEA_1_T4 (SEQ ID NO:26), for which the sequence(s) is/are given at the end of the application. The coding portion of transcript F05068_PEA_1_T4 (SEQ ID NO:26) is shown in bold; this coding portion starts at position 267 and ends at position 515. The transcript also has the following SNPs as listed in Table 171 (given according to their position on the nucleotide sequence, with the alternative nucleic acid listed; the last column indicates whether the SNP is known or not; the presence of known SNPs in variant protein F05068_PEA_1_P8 (SEQ ID NO:1305) sequence provides support for the deduced sequence of this variant protein according to the present invention).

TABLE 171

Nucleic acid SNPs

| SNP position on nucleotide sequence | Alternative nucleic acid | Previously known SNP? |
|---|---|---|
| 26 | C -> T | Yes |
| 164 | T -> | No |
| 443 | G -> C | Yes |
| 589 | C -> G | Yes |
| 943 | C -> | No |
| 943 | C -> A | No |
| 1105 | G -> A | No |
| 1106 | G -> A | No |

TABLE 171-continued

Nucleic acid SNPs

| SNP position on nucleotide sequence | Alternative nucleic acid | Previously known SNP? |
|---|---|---|
| 1106 | G -> C | Yes |
| 1167 | G -> A | Yes |
| 1171 | C -> | No |
| 1171 | C -> A | No |
| 177 | T -> | No |
| 1189 | C -> | No |
| 1189 | C -> A | No |
| 1232 | G -> | No |
| 1237 | C -> | No |
| 1254 | T -> G | Yes |
| 1275 | G -> | No |
| 1307 | C -> | No |
| 1349 | C -> | No |
| 1365 | C -> T | No |
| 1464 | G -> A | No |
| 206 | C -> T | Yes |
| 1533 | T -> | No |
| 1540 | T -> G | No |
| 1617 | C -> | No |
| 1618 | C -> | No |
| 1637 | A -> G | Yes |
| 1655 | A -> C | No |
| 1655 | A -> G | No |
| 1738 | A -> C | Yes |
| 1752 | T -> C | Yes |
| 1804 | C -> T | No |
| 245 | G -> | No |
| 259 | C -> | No |
| 276 | G -> T | No |
| 295 | A -> G | No |
| 317 | A -> C | Yes |
| 416 | C -> G | Yes |

As noted above, cluster F05068 features 12 segment(s), which were listed in Table 162 above and for which the sequence(s) are given at the end of the application. These segment(s) are portions of nucleic acid sequence(s) which are described herein separately because they are of particular interest. A description of each segment according to the present invention is now provided.

Segment cluster F05068_PEA_1_node_0 (SEQ ID NO:1145) according to the present invention is supported by 143 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 172 below describes the starting and ending position of this segment on each transcript.

TABLE 172

Segment location on transcripts

| Transcript name | Segment starting position | Segment ending position |
|---|---|---|
| F05068_PEA_1_T3 (SEQ ID NO:25) | 1 | 245 |
| F05068_PEA_1_T4 (SEQ ID NO:26) | 1 | 245 |
| F05068_PEA_1_T6 (SEQ ID NO:27) | 1 | 245 |

Segment cluster F05068_PEA_1_node_10 (SEQ ID NO:1146) according to the present invention is supported by 127 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 173 below describes the starting and ending position of this segment on each transcript.

TABLE 173

Segment location on transcripts

| Transcript name | Segment starting position | Segment ending position |
|---|---|---|
| F05068_PEA_1_T3 (SEQ ID NO:25) | 749 | 909 |
| F05068_PEA_1_T4 (SEQ ID NO:26) | 832 | 992 |
| F05068_PEA_1_T6 (SEQ ID NO:27) | 982 | 1142 |

Segment cluster F05068_PEA_1_node_12 (SEQ ID NO:1147) according to the present invention is supported by 123 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 174 below describes the starting and ending position of this segment on each transcript.

TABLE 174

Segment location on transcripts

| Transcript name | Segment starting position | Segment ending position |
|---|---|---|
| F05068_PEA_1_T3 (SEQ ID NO:25) | 986 | 1106 |
| F05068_PEA_1_T4 (SEQ ID NO:26) | 1069 | 1189 |
| F05068_PEA_1_T6 (SEQ ID NO:27) | 1219 | 1339 |

Segment cluster F05068_PEA_1_node_13 (SEQ ID NO:1148) according to the present invention is supported by 181 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 175 below describes the starting and ending position of this segment on each transcript.

TABLE 175

Segment location on transcripts

| Transcript name | Segment starting position | Segment ending position |
|---|---|---|
| F05068_PEA_1_T3 (SEQ ID NO:25) | 1107 | 1737 |
| F05068_PEA_1_T4 (SEQ ID NO:26) | 1190 | 1820 |
| F05068_PEA_1_T6 (SEQ ID NO:27) | 1340 | 1970 |

Segment cluster F05068_PEA_1_node_4 (SEQ ID NO:1149) according to the present invention is supported by 15 libraries. The number of libraries was determined as previously described. This segment can be found in the following transcript(s): F05068_PEA_1_T3 (SEQ ID NO:25) and F05068_PEA_1_T6 (SEQ ID NO:27). Table 176 below describes the starting and ending position of this segment on each transcript.

TABLE 176

Segment location on transcripts

| Transcript name | Segment starting position | Segment ending position |
|---|---|---|
| F05068_PEA_1_T3 (SEQ ID NO:25) | 365 | 514 |
| F05068_PEA_1_T6 (SEQ ID NO:27) | 365 | 514 |

Segment cluster F05068_PEA_1_node_8 (SEQ ID NO:1150) according to the present invention is supported by 13 libraries. The number of libraries was determined as previously described. This segment can be found in the following transcript(s): F05068_PEA_1_T4 (SEQ ID NO:26) and F05068_PEA_1_T6 (SEQ ID NO:27). Table 177 below describes the starting and ending position of this segment on each transcript.

TABLE 177

Segment location on transcripts

| Transcript name | Segment starting position | Segment ending position |
|---|---|---|
| F05068_PEA_1_T4 (SEQ ID NO:26) | 515 | 747 |
| F05068_PEA_1_T6 (SEQ ID NO:27) | 665 | 897 |

According to an optional embodiment of the present invention, short segments related to the above cluster are also provided. These segments are up to about 120 bp in length, and so are included in a separate description.

Segment cluster F05068_PEA_1_node_11 (SEQ ID NO:1151) according to the present invention is supported by 112 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 178 below describes the starting and ending position of this segment on each transcript.

TABLE 178

Segment location on transcripts

| Transcript name | Segment starting position | Segment ending position |
|---|---|---|
| F05068_PEA_1_T3 (SEQ ID NO:25) | 910 | 985 |
| F05068_PEA_1_T4 (SEQ ID NO:26) | 993 | 1068 |
| F05068_PEA_1_T6 (SEQ ID NO:27) | 1143 | 1218 |

Segment cluster F05068_PEA_1_node_3 (SEQ ID NO:1152) according to the present invention is supported by 145 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 179 below describes the starting and ending position of this segment on each transcript.

TABLE 179

Segment location on transcripts

| Transcript name | Segment starting position | Segment ending position |
|---|---|---|
| F05068_PEA_1_T3 (SEQ ID NO:25) | 246 | 364 |
| F05068_PEA_1_T4 (SEQ ID NO:26) | 246 | 364 |
| F05068_PEA_1_T6 (SEQ ID NO:27) | 246 | 364 |

Segment cluster F05068_PEA_1_node_5 (SEQ ID NO:1153) according to the present invention is supported by 124 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 180 below describes the starting and ending position of this segment on each transcript.

TABLE 180

Segment location on transcripts

| Transcript name | Segment starting position | Segment ending position |
|---|---|---|
| F05068_PEA_1_T3 (SEQ ID NO:25) | 515 | 573 |
| F05068_PEA_1_T4 (SEQ ID NO:26) | 365 | 423 |
| F05068_PEA_1_T6 (SEQ ID NO:27) | 515 | 573 |

Segment cluster F05068_PEA_1_node_6 (SEQ ID NO:1154) according to the present invention is supported by 110 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 181 below describes the starting and ending position of this segment on each transcript.

TABLE 181

Segment location on transcripts

| Transcript name | Segment starting position | Segment ending position |
|---|---|---|
| F05068_PEA_1_T3 (SEQ ID NO:25) | 574 | 613 |
| F05068_PEA_1_T4 (SEQ ID NO:26) | 424 | 463 |
| F05068_PEA_1_T6 (SEQ ID NO:27) | 574 | 613 |

Segment cluster F05068_PEA_1_node_7 (SEQ ID NO:1155) according to the present invention is supported by 109 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 182 below describes the starting and ending position of this segment on each transcript.

TABLE 182

```
1 MKLVSVALMYLGSLAFLGADTARLDVASEFRKK  33
  |||||||||||||||||||||||||||||||||
1 MKLVSVALMYLGSLAFLGADTARLDVASEFRKK  33
```

Segment location on transcripts

| Transcript name | Segment starting position | Segment ending position |
|---|---|---|
| F05068_PEA_1_T3 (SEQ ID NO:25) | 614 | 664 |
| F05068_PEA_1_T4 (SEQ ID NO:26) | 464 | 514 |
| F05068_PEA_1_T6 (SEQ ID NO:27) | 614 | 664 |

Segment cluster F05068_PEA_1_node_9 (SEQ ID NO:1156) according to the present invention is supported by 114 libraries. The number of libraries was determined as previously described. This segment can be found in the following transcript(s): F05068_PEA_1_T3 (SEQ ID NO:25), F05068_PEA_1_T4 (SEQ ID NO:26) and F05068_PEA_1_T6 (SEQ ID NO:27). Table 183 below describes the starting and ending position of this segment on each transcript.

TABLE 183

Segment location on transcripts

| Transcript name | Segment starting position | Segment ending position |
|---|---|---|
| F05068_PEA_1_T3 (SEQ ID NO:25) | 665 | 748 |
| F05068_PEA_1_T4 (SEQ ID NO:26) | 748 | 831 |
| F05068_PEA_1_T6 (SEQ ID NO:27) | 898 | 981 |

Variant protein alignment to the previously known protein:

Sequence name: /tmp/kEsi3RWsCN/1svdhjfiNV:ADML_HUMAN (SEQ ID NO:1423)

Sequence documentation:

Alignment of: F05068_PEA_1_P7 (SEQ ID NO:1304) x ADML_HUMAN (SEQ ID NO:1423)

Alignment segment 1/1:

| | |
|---|---|
| Quality: 304.00 | Escore: 0 |
| Matching length: 33 | Total length: 33 |
| Matching Percent Similarity: 100.00 | Matching Percent Identity: 100.00 |
| Total Percent Similarity: 100.00 | Total Percent Identity: 100.00 |
| Gaps: 0 | |

Alignment:

Sequence name: /tmp/tcrlWIx4 kg/aghbr8Eh8n:ADML_HUMAN (SEQ ID NO:1423)

Sequence documentation:

Alignment of: F05068_PEA_1_P8 (SEQ ID NO:1305) x ADML_HUMAN (SEQ ID NO:1423)

Alignment segment 1/1:

| | |
|---|---|
| Quality: 791.00 | Escore: 0 |
| Matching length: 82 | Total length: 82 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1 MKLVSVALMYLGSLAFLGADTARLDVASEFRKKWNKWALSRGKRELRMSS  50
   ||||||||||||||||||||||||||||||||||||||||||||||||||
 1 MKLVSVALMYLGSLAFLGADTARLDVASEFRKKWNKWALSRGKRELRMSS  50

51 SYPTGLADVKAGPAQTLIRPQDMKGASRSPED                    82
   |||||||||||||||||||||||||||||||
51 SYPTGLADVKAGPAQTLIRPQDMKGASRSPED                    82
```

Description for Cluster H14624

Cluster H14624 features 1 transcript(s) and 15 segment(s) of interest, the names for which are given in Tables 184 and 185, respectively, the sequences themselves are given at the end of the application. The selected protein variants are given in table 186.

TABLE 184

Transcripts of interest

| Transcript Name | Sequence ID No. |
|---|---|
| H14624_T20 | 28 |

TABLE 184

Segments of interest

| Segment Name | Sequence ID No. |
|---|---|
| H14624_node_0 | 362 |
| H14624_node_16 | 363 |
| H14624_node_3 | 364 |
| H14624_node_10 | 365 |
| H14624_node_11 | 366 |
| H14624_node_12 | 367 |
| H14624_node_13 | 368 |
| H14624_node_14 | 370 |
| H14624_node_15 | 371 |
| H14624_node_4 | 372 |
| H14624_node_5 | 373 |
| H14624_node_6 | 374 |
| H14624_node_7 | 375 |
| H14624_node_8 | 376 |
| H14624_node_9 | 377 |

TABLE 186

Proteins of interest

| Protein Name | Sequence ID No. |
|---|---|
| H14624_P15 | 1306 |

Cluster H14624 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 22 refer to weighted expression of ESTs in each category, as "parts per million" (ratio of the expression of ESTs for a particular cluster to the expression of all ESTs in that category, according to parts per million).

Figure 22:
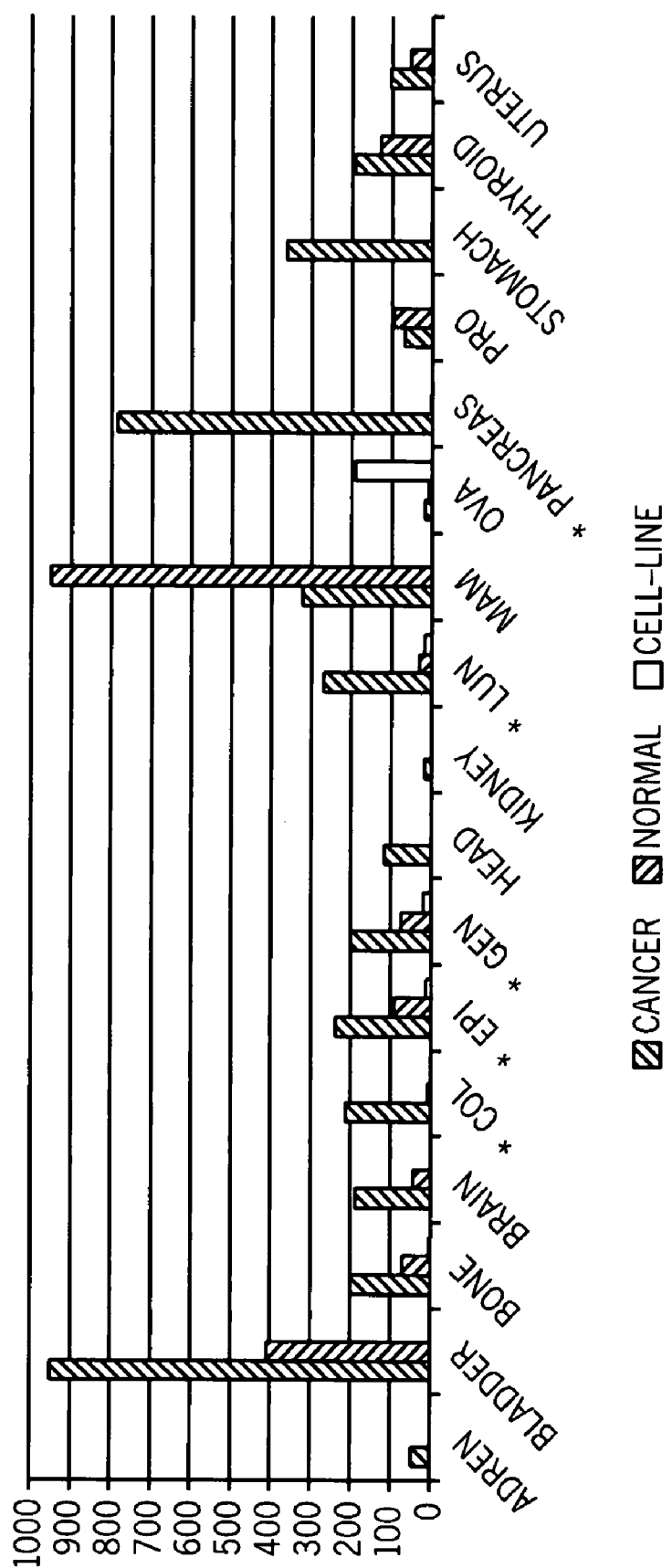
FIG. 22 is a histogram showing Cancer and cell-line vs. normal tissue expression for Cluster H14624, demonstrating overexpression in colorectal cancer, epithelial malignant tumors, a mixture of malignant tumors from different tissues, lung malignant tumors and pancreas carcinoma.

Overall, the following results were obtained as shown with regard to the histograms in FIG. 22 and Table 187. This cluster is overexpressed (at least at a minimum level) in the following pathological conditions: colorectal cancer, epithelial malignant tumors, a mixture of malignant tumors from different tissues, lung malignant tumors and pancreas carcinoma.

TABLE 187

Normal tissue distribution

| Name of Tissue | Number |
|---|---|
| adrenal | 0 |
| bladder | 410 |
| bone | 71 |
| brain | 42 |
| colon | 6 |
| epithelial | 91 |
| general | 74 |
| head and neck | 0 |
| kidney | 0 |
| lung | 30 |
| breast | 949 |
| ovary | 7 |
| pancreas | 2 |
| prostate | 94 |
| stomach | 3 |
| Thyroid | 128 |
| uterus | 54 |

TABLE 188

P values and ratios for expression in cancerous tissue

| Name of Tissue | P1 | P2 | SP1 | R3 | SP2 | R4 |
|---|---|---|---|---|---|---|
| adrenal | 4.2e−01 | 4.6e−01 | 4.6e−01 | 2.2 | 5.3e−01 | 1.9 |
| bladder | 5.4e−01 | 6.0e−01 | 1.2e−02 | 1.6 | 2.2e−01 | 1.0 |
| bone | 4.9e−01 | 8.5e−01 | 1.8e−01 | 1.3 | 7.5e−01 | 0.6 |
| brain | 4.7e−01 | 7.0e−01 | 6.3e−05 | 2.3 | 9.4e−03 | 1.4 |
| colon | 4.4e−02 | 9.9e−02 | 4.5e−03 | 5.4 | 2.0e−02 | 3.9 |
| epithelial | 7.7e−03 | 3.6e−01 | 1.5e−11 | 2.0 | 2.9e−02 | 1.1 |
| general | 5.1e−03 | 5.9e−01 | 8.3e−21 | 2.2 | 1.5e−04 | 1.2 |
| head and neck | 1.4e−01 | 2.8e−01 | 4.6e−01 | 2.2 | 7.5e−01 | 1.3 |
| kidney | 6.5e−01 | 7.2e−01 | 5.8e−01 | 1.7 | 7.0e−01 | 1.4 |
| lung | 6.1e−02 | 1.4e−01 | 3.3e−05 | 5.8 | 8.1e−03 | 2.9 |
| breast | 2.4e−01 | 4.1e−01 | 1 | 0.3 | 1 | 0.2 |
| ovary | 8.5e−01 | 7.3e−01 | 6.8e−01 | 1.2 | 1.6e−01 | 1.6 |
| pancreas | 7.5e−03 | 4.9e−02 | 1.2e−21 | 22.4 | 2.4e−16 | 15.1 |
| prostate | 8.3e−01 | 8.9e−01 | 7.2e−01 | 0.8 | 8.8e−01 | 0.6 |
| stomach | 4.6e−01 | 8.5e−01 | 1.0e−03 | 2.7 | 1.1e−01 | 1.4 |
| Thyroid | 7.0e−01 | 7.0e−01 | 5.9e−01 | 1.0 | 5.9e−01 | 1.0 |
| uterus | 4.1e−01 | 7.3e−01 | 2.3e−01 | 1.2 | 6.2e−01 | 0.7 |

As noted above, contig H14624 features 1 transcript(s), which were listed in Table 184 above. A description of each variant protein according to the present invention is now provided.

Variant protein H14624_P15 (SEQ ID NO:1306) according to the present invention has an amino acid sequence as given at the end of the application; it is encoded by transcript(s) H14624_T20 (SEQ ID NO:28). One or more alignments to one or more previously published protein sequences are given at the end of the application. A brief description of the relationship of the variant protein according to the present invention to each such aligned protein is as follows:

Comparison report between H14624_P15 (SEQ ID NO:1306) and Q9HAP5 (SEQ ID NO:1701):

1. An isolated chimeric polypeptide encoding for H14624_P15 (SEQ ID NO:1306), comprising a first amino acid sequence being at least 90% homologous to MLQG-PGSLLLLFLASHCCLGSARGLFLFGQPDFSYKR-SNCKPIPANLQLCHGIEYQNMRLPNLLGHETMKE VLEQAGAWIPLVMKQCHPDTKKFLCSLFAPVC-LDDLDETIQPCHSLCVQVKDRCAPVMSAFGFP-WPDML ECDRFPQDNDLCIPLASSDHLLPATEE corresponding to amino acids 1-167 of Q9HAP5 (SEQ ID NO:1701), which also corresponds to amino acids 1-167 of H14624_P15 (SEQ ID NO:1306), and a second amino acid sequence being at least 70%, optionally at least 80%, preferably at least 85%, more preferably at least 90% and most preferably at least 95% homologous to a polypeptide having the sequence GKPSLLLPHSLLG (SEQ ID NO: 1765) corresponding to amino acids 168-180 of H14624_P115 (SEQ ID NO:1306), wherein said first and second amino acid sequences are contiguous and in a sequential order.

2. An isolated polypeptide encoding for a tail of H14624_P15 (SEQ ID NO:1306), comprising a polypeptide being at least 70%, optionally at least about 80%, preferably at least about 85%, more preferably at least about 90% and most preferably at least about 95% homologous to the sequence GKPSLLLPHSLLG (SEQ ID NO:1765) in H14624_P15 (SEQ ID NO:1306).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H14624_P15 (SEQ ID NO:1306) also has the following non-silent SNPs (Single Nucleotide Polymorphisms) as listed in Table 189, (given according to their position(s) on the amino acid sequence, with the alternative amino acid(s) listed; the last column indicates whether the SNP is known or not; the presence of known SNPs in variant protein H14624_P15 (SEQ ID NO:1306) sequence provides support for the deduced sequence of this variant protein according to the present invention).

TABLE 189

Amino acid mutations

| SNP position(s) on amino acid sequence | Alternative amino acid(s) | Previously known SNP? |
|---|---|---|
| 11 | L -> | No |
| 170 | P -> S | Yes |
| 28 | F -> | No |
| 29 | G -> | No |
| 38 | S -> | No |
| 45 | A -> V | Yes |
| 60 | L -> | No |

Variant protein H14624_P15 (SEQ ID NO:1306) is encoded by the following transcript(s): H14624_T20 (SEQ ID NO:28), for which the sequence(s) is/are given at the end of the application. The coding portion of transcript H14624_T20 (SEQ ID NO:28) is shown in bold; this coding portion starts at position 857 and ends at position 1396. The transcript also has the following SNPs as listed in Table 190 (given according to their position on the nucleotide sequence, with the alternative nucleic acid listed; the last column indicates whether the SNP is known or not; the presence of known SNPs in variant protein H14624_P15 (SEQ ID NO:1306) sequence provides support for the deduced sequence of this variant protein according to the present invention).

TABLE 190

Nucleic acid SNPs

| SNP position on nucleotide sequence | Alternative nucleic acid | Previously known SNP? |
|---|---|---|
| 389 | A -> G | No |
| 476 | C -> T | No |
| 969 | G -> | No |
| 988 | G -> T | Yes |
| 990 | C -> T | Yes |
| 1034 | C -> | No |
| 1168 | C -> T | Yes |
| 1364 | C -> T | Yes |
| 488 | T -> C | No |
| 819 | C -> G | Yes |
| 851 | C -> | No |
| 887 | C -> | No |
| 922 | G -> A | Yes |
| 934 | C -> T | Yes |
| 938 | T -> | No |
| 943 | C -> | No |

As noted above, cluster H14624 features 15 segment(s), which were listed in Table 185 above and for which the sequence(s) are given at the end of the application. These segment(s) are portions of nucleic acid sequence(s) which are described herein separately because they are of particular interest. A description of each segment according to the present invention is now provided.

Segment cluster H14624_node_0 (SEQ ID NO:1157) according to the present invention is supported by 3 libraries. The number of libraries was determined as previously described. This segment can be found in the following transcript(s): H14624_T20 (SEQ ID NO:28). Table 191 below describes the starting and ending position of this segment on each transcript.

TABLE 191

| | Segment location on transcripts | |
|---|---|---|
| Transcript name | Segment starting position | Segment ending position |
| H14624_T20 (SEQ ID NO:28) | 1 | 573 |

Segment cluster H14624_node_16 (SEQ ID NO:1158) according to the present invention is supported by 3 libraries. The number of libraries was determined as previously described. This segment can be found in the following transcript(s): H14624_T20 (SEQ ID NO:28). Table 192 below describes the starting and ending position of this segment on each transcript.

TABLE 192

| | Segment location on transcripts | |
|---|---|---|
| Transcript name | Segment starting position | Segment ending position |
| H14624_T20 (SEQ ID NO:28) | 1359 | 1745 |

Segment cluster H14624_node_3 (SEQ ID NO:1159) according to the present invention is supported by 67 libraries. The number of libraries was determined as previously described. This segment can be found in the following transcript(s): H14624_T20 (SEQ ID NO:28). Table 193 below describes the starting and ending position of this segment on each transcript.

TABLE 193

| | Segment location on transcripts | |
|---|---|---|
| Transcript name | Segment starting position | Segment ending position |
| H14624_T20 (SEQ ID NO:28) | 574 | 822 |

According to an optional embodiment of the present invention, short segments related to the above cluster are also provided. These segments are up to about 120 bp in length, and so are included in a separate description.

Segment cluster H14624_node_10 (SEQ ID NO:1160) according to the present invention can be found in the following transcript(s): H14624_T20 (SEQ ID NO:28). Table 194 below describes the starting and ending position of this segment on each transcript.

TABLE 194

| | Segment location on transcripts | |
|---|---|---|
| Transcript name | Segment starting position | Segment ending position |
| H14624_T20 (SEQ ID NO:28) | 1070 | 1079 |

Segment cluster H14624_node_11 (SEQ ID NO:1161) according to the present invention is supported by 99 libraries. The number of libraries was determined as previously described. This segment can be found in the following transcript(s): H14624_T20 (SEQ ID NO:28). Table 195 below describes the starting and ending position of this segment on each transcript.

TABLE 195

| | Segment location on transcripts | |
|---|---|---|
| Transcript name | Segment starting position | Segment ending position |
| H14624_T20 (SEQ ID NO:28) | 1080 | 1114 |

Segment cluster H14624_node_12 (SEQ ID NO:1162) according to the present invention can be found in the following transcript(s): H14624_T20 (SEQ ID NO:28). Table 196 below describes the starting and ending position of this segment on each transcript.

TABLE 196

| | Segment location on transcripts | |
|---|---|---|
| Transcript name | Segment starting position | Segment ending position |
| H14624_T20 (SEQ ID NO:28) | 1115 | 1135 |

Segment cluster H14624_node_13 (SEQ ID NO:1163) according to the present invention is supported by 124 libraries. The number of libraries was determined as previously described. This segment can be found in the following transcript(s): H14624_T20 (SEQ ID NO:28). Table 197 below describes the starting and ending position of this segment on each transcript.

TABLE 197

| | Segment location on transcripts | |
|---|---|---|
| Transcript name | Segment starting position | Segment ending position |
| H14624_T20 (SEQ ID NO:28) | 1136 | 1227 |

Segment cluster H14624_node_14 (SEQ ID NO:1164) according to the present invention is supported by 114 libraries. The number of libraries was determined as previously described. This segment can be found in the following transcript(s): H14624_T20 (SEQ ID NO:28). Table 198 below describes the starting and ending position of this segment on each transcript.

TABLE 198

| | Segment location on transcripts | |
|---|---|---|
| Transcript name | Segment starting position | Segment ending position |
| H14624_T20 (SEQ ID NO:28) | 1228 | 1287 |

Segment cluster H14624_node_15 (SEQ ID NO:1165) according to the present invention is supported by 124 libraries. The number of libraries was determined as previously described. This segment can be found in the following transcript(s): H14624_T20 (SEQ ID NO:28). Table 199 below describes the starting and ending position of this segment on each transcript.

TABLE 199

| | Segment location on transcripts | |
|---|---|---|
| Transcript name | Segment starting position | Segment ending position |
| H14624_T20 (SEQ ID NO:28) | 1288 | 1358 |

Segment cluster H14624_node_4 (SEQ ID NO:1166) according to the present invention is supported by 65 libraries. The number of libraries was determined as previously described. This segment can be found in the following transcript(s): H14624_T20 (SEQ ID NO:28). Table 200 below describes the starting and ending position of this segment on each transcript.

TABLE 200

| | Segment location on transcripts | |
|---|---|---|
| Transcript name | Segment starting position | Segment ending position |
| H14624_T20 (SEQ ID NO:28) | 823 | 892 |

Segment cluster H14624_node_5 (SEQ ID NO:1167) according to the present invention can be found in the following transcript(s): H14624_T20 (SEQ ID NO:28). Table 201 below describes the starting and ending position of this segment on each transcript.

TABLE 201

| | Segment location on transcripts | |
|---|---|---|
| Transcript name | Segment starting position | Segment ending position |
| H14624_T20 (SEQ ID NO:28) | 893 | 903 |

Segment cluster H14624_node_6 (SEQ ID NO:1168) according to the present invention can be found in the following transcript(s): H14624_T20 (SEQ ID NO:28). Table 202 below describes the starting and ending position of this segment on each transcript.

TABLE 202

Segment location on transcripts

| Transcript name | Segment starting position | Segment ending position |
|---|---|---|
| H14624_T20 (SEQ ID NO:28) | 904 | 927 |

Segment cluster H14624_node_7 (SEQ ID NO:1169) according to the present invention can be found in the following transcript(s): H14624_T20 (SEQ ID NO:28). Table 203 below describes the starting and ending position of this segment on each transcript.

TABLE 203

Segment location on transcripts

| Transcript name | Segment starting position | Segment ending position |
|---|---|---|
| H14624_T20 (SEQ ID NO:28) | 928 | 934 |

Segment cluster H14624_node_8 (SEQ ID NO:1170) according to the present invention is supported by 85 libraries. The number of libraries was determined as previously described. This segment can be found in the following transcript(s): H14624_T20 (SEQ ID NO:28). Table 204 below describes the starting and ending position of this segment on each transcript.

TABLE 204

Segment location on transcripts

| Transcript name | Segment starting position | Segment ending position |
|---|---|---|
| H14624_T20 (SEQ ID NO:28) | 935 | 1014 |

Segment cluster H14624_node_9 (SEQ ID NO:1171) according to the present invention is supported by 87 libraries. The number of libraries was determined as previously described. This segment can be found in the following transcript(s): H14624_T20 (SEQ ID NO:28). Table 205 below describes the starting and ending position of this segment on each transcript.

TABLE 205

Segment location on transcripts

| Transcript name | Segment starting position | Segment ending position |
|---|---|---|
| H14624_T20 (SEQ ID NO:28) | 1015 | 1069 |

Variant protein alignment to the previously known protein:

Sequence name: /tmp/Upb1SbFkrj/N4PrGQAB2V:Q9HAP5 (SEQ ID NO:1701)

Sequence documentation:

Alignment of: H14624_P15 (SEQ ID NO:1306) x Q9HAP5 (SEQ ID NO:1701)

Alignment segment 1/1:

| | |
|---|---|
| Quality: 1702.00 | Escore: 0 |
| Matching length: 167 | Total length: 167 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MLQGSPGSLLLLFLASHCCLGSARGLFLGQPDFSYKRSNCKPIPANLQLC  50
    ||||||||||||||||||||||||||||||||||||||||||||||||||
  1 MLQGSPGSLLLLFLASHCCLGSARGLFLGQPDFSYKRSNCKPIPANLQLC  50

51 HGIEYQNMRLPNLLGHETMKEVLEQAGAWIPLVMKQCHPDTKKFLCSLFA 100
    ||||||||||||||||||||||||||||||||||||||||||||||||||
 51 HGIEYQNMRLPNLLGHETMKEVLEQAGAWIPLVMKQCHPDTKKFLCSLFA 100

101 PVCLDDLDETIQPCHSLCVQVKDRCAPVMSAFGFPWPDMLECDRFPQDND 150
    ||||||||||||||||||||||||||||||||||||||||||||||||||
101 PVCLDDLDETIQPCHSLCVQVKDRCAPVMSAFGFPWPDMLECDRFPQDND 150

151 LCIPLASSDHLLPATEE                                 167
    |||||||||||||||||
101 LCIPLASSDHLLPATEE                                 167
```

Description for Cluster H38804

Cluster H38804 features 2 transcript(s) and 20 segment(s) of interest, the names for which are given in Tables 206 and 207, respectively, the sequences themselves are given at the end of the application. The selected protein variants are given in table 208.

TABLE 206

Transcripts of interest

| Transcript Name | Sequence ID No. |
|---|---|
| H38804_PEA_1_T24 | 29 |
| H38804_PEA_1_T8 | 30 |

TABLE 207

Segments of interest

| Segment Name | Sequence ID No. |
|---|---|
| H38804_PEA_1_node_0 | 378 |
| H38804_PEA_1_node_1 | 379 |
| H38804_PEA_1_node_16 | 380 |
| H38804_PEA_1_node_19 | 381 |
| H38804_PEA_1_node_24 | 382 |
| H38804_PEA_1_node_25 | 383 |
| H38804_PEA_1_node_28 | 384 |
| H38804_PEA_1_node_29 | 385 |
| H38804_PEA_1_node_30 | 386 |
| H38804_PEA_1_node_10 | 387 |
| H38804_PEA_1_node_12 | 388 |
| H38804_PEA_1_node_13 | 389 |
| H38804_PEA_1_node_14 | 390 |
| H38804_PEA_1_node_2 | 391 |
| H38804_PEA_1_node_20 | 392 |
| H38804_PEA_1_node_23 | 393 |
| H38804_PEA_1_node_26 | 394 |
| H38804_PEA_1_node_3 | 395 |
| H38804_PEA_1_node_4 | 396 |
| H38804_PEA_1_node_5 | 397 |

TABLE 208

Proteins of interest

| Protein Name | Sequence ID No. |
|---|---|
| H38804_PEA_1_P5 | 1307 |
| H38804_PEA_1_P17 | 1308 |

These sequences are variants of the known protein Mitotic checkpoint protein BUB3 (SwissProt accession identifier BUB3_HUMAN), SEQ ID NO:1424, referred to herein as the previously known protein.

Protein Mitotic checkpoint protein BUB3 (SEQ ID NO:1424) is known or believed to have the following function(s): Required for kinetochore localization of BUB1. The sequence for protein Mitotic checkpoint protein BUB3 is given at the end of the application, as "Mitotic checkpoint protein BUB3 amino acid sequence". Known polymorphisms for this sequence are as shown in Table 209

TABLE 209

Amino acid mutations for Known Protein

| SNP position(s) on amino acid sequence | Comment |
|---|---|
| 326-327 | Missing |

Protein Mitotic checkpoint protein BUB3 (SEQ ID NO:1424) localization is believed to be Nuclear.

The following GO Annotation(s) apply to the previously known protein. The following annotation(s) were found: mitosis; mitotic checkpoint; mitotic spindle checkpoint; cell proliferation, which are annotation(s) related to Biological Process; and nucleus, which are annotation(s) related to Cellular Component.

The GO assignment relies on information from one or more of the SwissProt/TreBl Protein knowledgebase, available from <dot expasy dot ch/sprot/>; or Locuslink, available from <dot ncbi dot nlm dot nih dot gov/projects/LocusLink/>.

Cluster H38804 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 23 refer to weighted expression of ESTs in each category, as "parts per million" (ratio of the expression of ESTs for a particular cluster to the expression of all ESTs in that category, according to parts per million).

Figure 23:
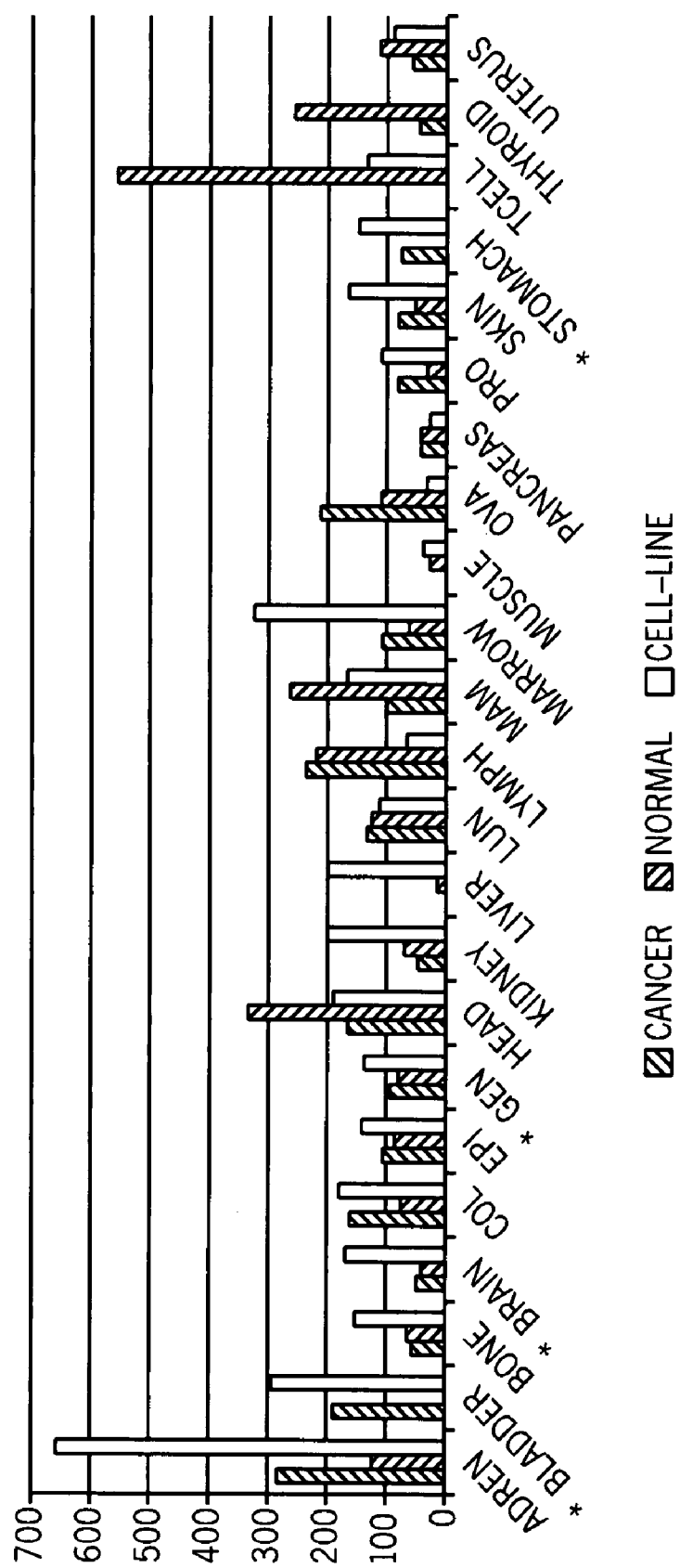
FIG. 23 is a histogram showing Cancer and cell-line vs. normal tissue expression for Cluster H38804, demonstrating overexpression in transitional cell carcinoma, brain malignant tumors, a mixture of malignant tumors from different tissues and gastric carcinoma.

Overall, the following results were obtained as shown with regard to the histograms in FIG. 23 and Table 210. This cluster is overexpressed (at least at a minimum level) in the following pathological conditions: transitional cell carcinoma, brain malignant tumors, a mixture of malignant tumors from different tissues and gastric carcinoma.

TABLE 210

Normal tissue distribution

| Name of Tissue | Number |
|---|---|
| adrenal | 124 |
| bladder | 0 |
| bone | 64 |
| brain | 40 |
| colon | 75 |
| epithelial | 86 |
| general | 79 |
| head and neck | 334 |
| kidney | 69 |
| liver | 14 |
| lung | 125 |
| lymph nodes | 218 |
| breast | 263 |
| bone marrow | 62 |
| muscle | 27 |
| ovary | 109 |
| pancreas | 43 |
| prostate | 32 |
| skin | 53 |
| stomach | 0 |
| T cells | 557 |
| Thyroid | 257 |
| uterus | 113 |

TABLE 211

P values and ratios for expression in cancerous tissue

| Name of Tissue | P1 | P2 | SP1 | R3 | SP2 | R4 |
|---|---|---|---|---|---|---|
| adrenal | 6.3e−01 | 5.4e−01 | 1.8e−01 | 1.4 | 5.0e−02 | 1.9 |
| bladder | 7.0e−02 | 2.6e−02 | 3.2e−02 | 4.9 | 9.9e−03 | 6.2 |
| bone | 3.7e−01 | 2.3e−01 | 7.9e−01 | 0.9 | 3.2e−01 | 1.6 |
| brain | 3.1e−02 | 4.2e−03 | 5.3e−01 | 1.2 | 1.1e−02 | 2.1 |
| colon | 2.4e−01 | 1.1e−01 | 2.0e−01 | 1.7 | 1.6e−01 | 1.8 |
| epithelial | 1.1e−01 | 2.2e−02 | 1.5e−01 | 1.2 | 8.6e−03 | 1.3 |
| general | 2.3e−02 | 2.3e−04 | 9.0e−02 | 1.2 | 4.7e−05 | 1.4 |
| head and neck | 4.4e−01 | 4.7e−01 | 9.2e−01 | 0.6 | 8.9e−01 | 0.5 |
| kidney | 8.2e−01 | 8.4e−01 | 9.0e−01 | 0.8 | 3.5e−01 | 1.0 |
| liver | 8.3e−01 | 1.5e−01 | 1 | 0.8 | 5.3e−02 | 2.8 |
| lung | 6.9e−01 | 8.1e−01 | 5.1e−01 | 1.1 | 6.0e−01 | 0.8 |
| lymph nodes | 5.1e−01 | 6.9e−01 | 5.0e−01 | 0.9 | 9.5e−01 | 0.5 |
| breast | 4.9e−01 | 4.2e−01 | 9.7e−01 | 0.5 | 9.5e−01 | 0.5 |
| bone marrow | 6.7e−01 | 5.4e−01 | 1 | 1.5 | 3.3e−02 | 2.6 |
| muscle | 8.5e−01 | 6.1e−01 | 1 | 0.4 | 6.3e−01 | 1.0 |
| ovary | 3.4e−01 | 3.3e−01 | 2.5e−01 | 1.5 | 4.7e−01 | 1.1 |
| pancreas | 4.3e−01 | 4.9e−01 | 6.3e−01 | 1.0 | 6.9e−01 | 0.9 |
| prostate | 7.4e−01 | 6.5e−01 | 1.5e−01 | 1.9 | 1.0e−01 | 2.0 |
| skin | 6.0e−01 | 1.7e−01 | 5.4e−01 | 1.4 | 2.7e−02 | 1.2 |
| stomach | 4.5e−02 | 9.9e−03 | 2.5e−01 | 3.1 | 4.3e−02 | 4.3 |
| T cells | 5.0e−01 | 6.7e−01 | 1 | 0.3 | 9.8e−01 | 0.5 |
| Thyroid | 5.7e−01 | 5.7e−01 | 1 | 0.4 | 1 | 0.4 |
| uterus | 5.7e−01 | 6.7e−01 | 9.2e−01 | 0.6 | 8.7e−01 | 0.5 |

As noted above, cluster H38804 features 2 transcript(s), which were listed in Table 206 above. These transcript(s) encode for protein(s) which are variant(s) of protein Mitotic checkpoint protein BUB3 (SEQ ID NO:1424). A description of each variant protein according to the present invention is now provided.

Variant protein H38804_PEA_1_P5 (SEQ ID NO:1307) according to the present invention has an amino acid sequence as given at the end of the application; it is encoded by transcript(s) H38804_PEA_1_T8 (SEQ ID NO:30). An alignment is given to the known protein (Mitotic checkpoint protein BUB3 (SEQ ID NO:1424)) at the end of the application. One or more alignments to one or more previously published protein sequences are given at the end of the application. A brief description of the relationship of the variant protein according to the present invention to each such aligned protein is as follows:

Comparison report between H38804_PEA_1_P5 (SEQ ID NO:1307) and BUB3_HUMAN (SEQ ID NO:1424):

1. An isolated chimeric polypeptide encoding for H38804_PEA_1_P5 (SEQ ID NO:1307), comprising a first amino acid sequence being at least 70%, optionally at least 80%, preferably at least 85%, more preferably at least 90% and most preferably at least 95% homologous to a polypeptide having the sequence MGRVRTLAGECSAQAQAQS-LLAVVLSAPPSGGTPSARLSVRSPSPRD-PWGLWAPVLQ (SEQ ID NO:1766) corresponding to amino acids 1-57 of H38804_PEA_1_P5 (SEQ ID NO:1307), and a second amino acid sequence being at least 90% homologous to MTGSNEFKLNQPPEDGISSVKFSP-NTSQFLLVSSWDTSVRLYDVPANSMRLKYQHTGAV-LDCAFYDPTHA WSGGLDHQLKMHDLNTDQEN-LVGTHDAPIRCVEYCPEVNVMVTGSWDQTVKLW-DPRTPCNAGTFSQPE KVYTLSVSGDRLIVGTAGRRV-LVWDLRNMGYVQQRRESSLKYQTRCIRAFPNKQG-YVLSSIEGRVAVEYL DPSPEVQKKKYAFKCHRLKEN-NIEQIYPVNAISFHNIHNTFATGGSDG-FVNIWDPFNKKRLCQFHRYPTSIA SLAFSNDGTTLA-IASSYMYEMDDTEHPEDGIFIRQVTDAETKPK corresponding to amino acids 1-324 of BUB3_HUMAN (SEQ ID NO:1424), which also corresponds to amino acids 58-381 of H38804_PEA_1_P5 (SEQ ID NO:1307), wherein said first and second amino acid sequences are contiguous and in a sequential order.

2. An isolated polypeptide encoding for a head of H38804_PEA_1_P5 (SEQ ID NO:1307), comprising a polypeptide being at least 70%, optionally at least about 80%, preferably at least about 85%, more preferably at least about 90% and most preferably at least about 95% homologous to the sequence MGRVRTLAGECSAQAQAQSLLAVVL-SAPPSGGTPSARLSVRSPSPRDPWGLWAPVLQ (SEQ ID NO:1766) of H38804_PEA_1_P5 (SEQ ID NO:1307).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein H38804_PEA_1_P5 (SEQ ID NO:1307) also has the following non-silent SNPs (Single Nucleotide Polymorphisms) as listed in Table 212, (given according to their position(s) on the amino acid sequence, with the alternative amino acid(s) listed; the last column indicates whether the SNP is known or not; the presence of known SNPs in variant protein H38804_PEA_1_P5 (SEQ ID NO:1307) sequence provides support for the deduced sequence of this variant protein according to the present invention).

TABLE 212

Amino acid mutations

| SNP position(s) on amino acid sequence | Alternative amino acid(s) | Previously known SNP? |
|---|---|---|
| 126 | H -> Y | No |
| 129 | S -> R | Yes |
| 256 | I -> | No |
| 256 | I -> N | No |
| 258 | G -> | No |
| 266 | D -> | No |
| 266 | D -> E | No |
| 266 | D -> N | Yes |
| 296 | A -> G | No |
| 296 | A -> V | No |
| 306 | F -> C | No |
| 314 | F -> | No |
| 215 | R -> K | No |
| 361 | T -> A | No |
| 381 | K -> | No |
| 217 | L -> | No |
| 220 | D -> | No |
| 220 | D -> E | No |
| 245 | F -> | No |
| 245 | F -> V | No |
| 248 | K -> | No |
| 248 | K -> Q | No |

Variant protein H38804_PEA_1_P5 (SEQ ID NO:1307) is encoded by the following transcript(s): H38804_PEA_1_T8 (SEQ ID NO:30), for which the sequence(s) is/are given at the end of the application. The coding portion of transcript H38804_PEA_1_T8 (SEQ ID NO:30) is shown in bold; this coding portion starts at position 475 and ends at position 1617. The transcript also has the following SNPs as listed in Table 213 (given according to their position on the nucleotide sequence, with the alternative nucleic acid listed; the last column indicates whether the SNP is known or not; the presence of known SNPs in variant protein H38804_PEA_1_P5 (SEQ ID NO:1307) sequence provides support for the deduced sequence of this variant protein according to the present invention).

TABLE 213

Nucleic acid SNPs

| SNP position on nucleotide sequence | Alternative nucleic acid | Previously known SNP? |
|---|---|---|
| 161 | C -> | No |
| 167 | C -> | No |
| 1118 | G -> A | No |
| 1123 | T -> | No |
| 1134 | C -> | No |
| 1134 | C -> A | No |
| 1207 | T -> | No |
| 1207 | T -> G | No |
| 1216 | A -> | No |
| 1216 | A -> C | No |
| 1241 | T -> | No |
| 1241 | T -> A | No |
| 167 | C -> A | No |
| 1248 | C -> | No |
| 1248 | C -> G | No |
| 1270 | G -> A | Yes |
| 1272 | C -> | No |
| 1272 | C -> A | No |
| 1361 | C -> G | No |
| 1361 | C -> T | No |
| 1391 | T -> G | No |

TABLE 213-continued

Nucleic acid SNPs

| SNP position on nucleotide sequence | Alternative nucleic acid | Previously known SNP? |
|---|---|---|
| 1414 | T -> | No |
| 1419 | A -> G | No |
| 192 | T -> | No |
| 1555 | A -> G | No |
| 1615 | A -> | No |
| 1642 | G -> A | Yes |
| 1846 | T -> C | Yes |
| 2090 | A -> G | No |
| 2356 | C -> G | No |
| 2712 | G -> | No |
| 2909 | T -> C | No |
| 2909 | T -> G | No |
| 3020 | T -> G | No |
| 208 | C -> T | Yes |
| 3251 | T -> | No |
| 3306 | T -> | No |
| 3307 | T -> G | No |
| 3354 | T -> | No |
| 3521 | -> G | No |
| 3601 | C -> | No |
| 3601 | C -> G | No |
| 3633 | T -> | No |
| 3633 | T -> G | No |
| 3638 | A -> | No |
| 849 | G -> T | No |
| 3638 | A -> C | No |
| 3674 | C -> T | Yes |
| 3812 | T -> G | No |
| 3862 | G -> A | Yes |
| 3864 | T -> A | No |
| 3865 | T -> A | No |
| 3990 | T -> G | No |
| 4096 | T -> G | No |
| 4152 | G -> A | Yes |
| 850 | C -> T | No |
| 855 | C -> T | Yes |
| 861 | T -> G | Yes |
| 1098 | T -> C | No |

Variant protein H38804_PEA_1_P17 (SEQ ID NO:1308) according to the present invention has an amino acid sequence as given at the end of the application; it is encoded by transcript(s) H38804_PEA_1_T24 (SEQ ID NO:29). An alignment is given to the known protein (Mitotic checkpoint protein BUB3 (SEQ ID NO:1424)) at the end of the application. One or more alignments to one or more previously published protein sequences are given at the end of the application. A brief description of the relationship of the variant protein according to the present invention to each such aligned protein is as follows:

Comparison report between H38804_PEA_1_P17 (SEQ ID NO:1308) and BUB3_HUMAN (SEQ ID NO:1424):

1. An isolated chimeric polypeptide encoding for H38804_PEA_1_P17 (SEQ ID NO:1308), comprising a first amino acid sequence being at least 70%, optionally at least 80%, preferably at least 85%, more preferably at least 90% and most preferably at least 95% homologous to a polypeptide having the sequence MGRVRTLAGECSAQAQAQSLLAVVLSAPPSGGTPSARLSVRSPSPRDPWGLWAPVLQ (SEQ ID NO:1766) corresponding to amino acids 1-57 of H38804_PEA_1_P17 (SEQ ID NO:1308), and a second amino acid sequence being at least 90% homologous to MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT corresponding to amino acids 1-328 of BUB3_HUMAN (SEQ ID NO:1424), which also corresponds to amino acids 58-385 of H38804_PEA_1_P17 (SEQ ID NO:1308), wherein said first and second amino acid sequences are contiguous and in a sequential order.

2. An isolated polypeptide encoding for a head of H38804_PEA_1_P17(SEQ ID NO:1308), comprising a polypeptide being at least 70%, optionally at least about 80%, preferably at least about 85%, more preferably at least about 90% and most preferably at least about 95% homologous to the sequence MGRVRTLAGECSAQAQAQSLLAVVLSAPPSGGTPSARLSVRSPSPRDPWGLWAPVLQ (SEQ ID NO:1766) of H38804_PEA_1_P17 (SEQ ID NO:1308).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein H38804_PEA_1_P17 (SEQ ID NO:1308) also has the following non-silent SNPs (Single Nucleotide Polymorphisms) as listed in Table 214, (given according to their position(s) on the amino acid sequence, with the alternative amino acid(s) listed; the last column indicates whether the SNP is known or not; the presence of known SNPs invariant protein H38804_PEA_1_P17 (SEQ ID NO:1308) sequence provides support for the deduced sequence of this variant protein according to the present invention).

TABLE 214

Amino acid mutations

| SNP position(s) on amino acid sequence | Alternative amino acid(s) | Previously known SNP? |
|---|---|---|
| 126 | H -> Y | No |
| 129 | S -> R | Yes |
| 256 | I -> | No |
| 256 | I -> N | No |
| 258 | G -> | No |
| 266 | D -> | No |
| 266 | D -> E | No |
| 266 | D -> N | Yes |
| 296 | A -> G | No |
| 296 | A -> V | No |
| 306 | F -> C | No |
| 314 | F -> | No |
| 215 | R -> K | No |
| 361 | T -> A | No |
| 381 | K -> | No |
| 217 | L -> | No |
| 220 | D -> | No |
| 220 | D -> E | No |
| 245 | F -> | No |
| 245 | F -> V | No |
| 248 | K -> | No |
| 248 | K -> Q | No |

Variant protein H38804_PEA_1_P17 (SEQ ID NO:1308) is encoded by the following transcript(s): H38804_PEA_1_T24 (SEQ ID NO:29), for which the sequence(s) is/are given at the end of the application. The coding portion of transcript H38804_PEA_1_T24 (SEQ ID NO:29) is shown in bold; this coding portion starts at position 475 and ends at position 1629. The transcript also has the following SNPs as listed in Table 215 (given according to their position on the nucleotide sequence, with the alternative nucleic acid listed; the last column indicates whether the SNP is known or not; the presence of known SNPs in variant protein H38804_PEA_1_P17 (SEQ ID NO:1308) sequence provides support for the deduced sequence of this variant protein according to the present invention).

TABLE 215

Nucleic acid SNPs

| SNP position on nucleotide sequence | Alternative nucleic acid | Previously known SNP? |
|---|---|---|
| 161 | C -> | No |
| 167 | C -> | No |
| 1118 | G -> A | No |
| 1123 | T -> | No |
| 1134 | C -> | No |
| 1134 | C -> A | No |
| 1207 | T -> | No |
| 1207 | T -> G | No |
| 1216 | A -> | No |
| 1216 | A -> C | No |
| 1241 | T -> | No |
| 1241 | T -> A | No |
| 167 | C -> A | No |
| 1248 | C -> | No |
| 1248 | C -> G | No |
| 1270 | G -> A | Yes |
| 1272 | C -> | No |
| 1272 | C -> A | No |
| 1361 | C -> G | No |
| 1361 | C -> T | No |
| 1391 | T -> G | No |
| 1414 | T -> | No |
| 1419 | A -> G | No |
| 192 | T -> | No |
| 1555 | A -> G | No |
| 1615 | A -> | No |
| 1721 | G -> | No |
| 1918 | T -> C | No |
| 1918 | T -> G | No |
| 2029 | T -> G | No |
| 2260 | T -> | No |
| 2315 | T -> | No |
| 2316 | T -> G | No |
| 2363 | T -> | No |
| 208 | C -> T | Yes |
| 2530 | -> G | No |
| 2610 | C -> | No |
| 2610 | C -> G | No |
| 2642 | T -> | No |
| 2642 | T -> G | No |
| 2647 | A -> | No |
| 2647 | A -> C | No |
| 2683 | C -> T | Yes |
| 2821 | T -> G | No |
| 2871 | G -> A | Yes |
| 849 | G -> T | No |
| 2873 | T -> A | No |
| 2874 | T -> A | No |
| 2999 | T -> G | No |
| 3105 | T -> G | No |
| 3161 | G -> A | Yes |
| 850 | C -> T | No |
| 855 | C -> T | Yes |
| 861 | T -> G | Yes |
| 1098 | T -> C | No |

As noted above, cluster H38804 features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H38804_PEA_1_node_0 (SEQ ID NO:1172) according to the present invention is supported by 125 libraries. The number of libraries was determined as previously described. This segment can be found in the following transcript(s): H38804_PEA_1_T24 (SEQ ID NO:29) and H38804_PEA_1_T8 (SEQ ID NO:30). Table 216 below describes the starting and ending position of this segment on each transcript.

TABLE 216

Segment location on transcripts

| Transcript name | Segment starting position | Segment ending position |
|---|---|---|
| H38804_PEA_1_T24 (SEQ ID NO:29) | 1 | 213 |
| H38804_PEA_1_T8 (SEQ ID NO:30) | 1 | 213 |

Segment cluster H38804_PEA_1_node_1 (SEQ ID NO:1173) according to the present invention is supported by 9 libraries. The number of libraries was determined as previously described. This segment can be found in the following transcript(s): H38804_PEA_1_T24 (SEQ ID NO:29) and H38804_PEA_1_T8 (SEQ ID NO:30). Table 217 below describes the starting and ending position of this segment on each transcript.

TABLE 217

Segment location on transcripts

| Transcript name | Segment starting position | Segment ending position |
|---|---|---|
| H38804_PEA_1_T24 (SEQ ID NO:29) | 214 | 645 |
| H38804_PEA_1_T8 (SEQ ID NO:30) | 214 | 645 |

Segment cluster H38804_PEA_1_node_16 (SEQ ID NO:1174) according to the present invention is supported by 214 libraries. The number of libraries was determined as previously described. This segment can be found in the following transcript(s): H38804_PEA_1_T24 (SEQ ID NO:29) and H38804_PEA_1_T8 (SEQ ID NO:30). Table 218 below describes the starting and ending position of this segment on each transcript.

TABLE 218

Segment location on transcripts

| Transcript name | Segment starting position | Segment ending position |
|---|---|---|
| H38804_PEA_1_T24 (SEQ ID NO:29) | 1063 | 1221 |
| H38804_PEA_1_T8 (SEQ ID NO:30) | 1063 | 1221 |

Segment cluster H38804_PEA_1_node_19 (SEQ ID NO:1175) according to the present invention is supported by 198 libraries. The number of libraries was determined as previously described. This segment can be found in the following transcript(s): H38804_PEA_1_T24 (SEQ ID NO:29) and H38804_PEA_1_T8 (SEQ ID NO:30). Table 219 below describes the starting and ending position of this segment on each transcript.

TABLE 219

Segment location on transcripts

| Transcript name | Segment starting position | Segment ending position |
|---|---|---|
| H38804_PEA_1_T24 (SEQ ID NO:29) | 1222 | 1360 |
| H38804_PEA_1_T8 (SEQ ID NO:30) | 1222 | 1360 |

Segment cluster H38804_PEA_1_node_24 (SEQ ID NO:1176) according to the present invention is supported by 180 libraries. The number of libraries was determined as previously described. This segment can be found in the following transcript(s): H38804_PEA_1_T24 (SEQ ID NO:29) and H38804_PEA_1_T8 (SEQ ID NO:30). Table 220 below describes the starting and ending position of this segment on each transcript.

TABLE 220

Segment location on transcripts

| Transcript name | Segment starting position | Segment ending position |
|---|---|---|
| H38804_PEA_1_T24 (SEQ ID NO:29) | 1421 | 1616 |
| H38804_PEA_1_T8 (SEQ IS NO:30) | 1421 | 16161 |

Segment cluster H38804_PEA_1_node_25 (SEQ ID NO:1177) according to the present invention is supported by 28 libraries. The number of libraries was determined as previously described. This segment can be found in the following transcript(s): H38804_PEA_1_T8 (SEQ ID NO:30). Table 221 below describes the starting and ending position of this segment on each transcript.

TABLE 221

Segment location on transcripts

| Transcript name | Segment starting position | Segment ending position |
|---|---|---|
| H38804_PEA_1_T8 (SEQ ID NO:30) | 1617 | 1969 |

Segment cluster H38804_PEA_1_node_28 (SEQ ID NO:1178) according to the present invention is supported by 38 libraries. The number of libraries was determined as previously described. This segment can be found in the following transcript(s): H38804_PEA_1_T8 (SEQ ID NO:30). Table 222 below describes the starting and ending position of this segment on each transcript.

TABLE 222

Segment location on transcripts

| Transcript name | Segment starting position | Segment ending position |
|---|---|---|
| H38804_PEA_1_T8 (SEQ ID NO:30) | 2018 | 2607 |

Segment cluster H38804_PEA_1_node_29 (SEQ ID NO:1179) according to the present invention is supported by 259 libraries. The number of libraries was determined as previously described. This segment can be found in the following transcript(s): H38804_PEA_1_T24 (SEQ ID NO:29) and H38804_PEA_1_T8 (SEQ ID NO:30). Table 223 below describes the starting and ending position of this segment on each transcript.

TABLE 223

Segment location on transcripts

| Transcript name | Segment starting position | Segment ending position |
|---|---|---|
| H38804_PEA_1_T24 (SEQ ID NO:29) | 1617 | 2844 |
| H38804_PEA_1_T8 (SEQ ID NO:30) | 2608 | 3835 |

Segment cluster H38804_PEA_1_node_30 (SEQ ID NO:1180) according to the present invention is supported by 169 libraries. The number of libraries was determined as previously described. This segment can be found in the following transcript(s): H38804_PEA_1_T24 (SEQ ID NO:29) and H38804_PEA_1_T8 (SEQ ID NO:30). Table 224 below describes the starting and ending position of this segment on each transcript.

TABLE 224

Segment location on transcripts

| Transcript name | Segment starting position | Segment ending position |
|---|---|---|
| H38804_PEA_1_T24 (SEQ ID NO:29) | 2845 | 3170 |
| H38804_PEA_1_T8 (SEQ ID NO:30) | 3836 | 4161 |

According to an optional embodiment of the present invention, short segments related to the above cluster are also provided. These segments are up to about 120 bp in length, and so are included in a separate description.

Segment cluster H38804_PEA_1_node_10 (SEQ ID NO:1181) according to the present invention is supported by 179 libraries. The number of libraries was determined as previously described. This segment can be found in the following transcript(s): H38804_PEA_1_T24 (SEQ ID NO:29) and H38804_PEA_1_T8 (SEQ ID NO:30). Table 225 below describes the starting and ending position of this segment on each transcript.

TABLE 225

Segment location on transcripts

| Transcript name | Segment starting position | Segment ending position |
|---|---|---|
| H38804_PEA_1_T24 (SEQ ID NO:29) | 841 | 910 |
| H38804_PEA_1_T8 (SEQ ID NO:30) | 841 | 910 |

Segment cluster H38804_PEA_1_node_12 (SEQ ID NO:1182) according to the present invention is supported by 181 libraries. The number of libraries was determined as previously described. This segment can be found in the following transcript(s): H38804_PEA_1_T24 (SEQ ID NO:29)

and H38804_PEA_1_T8 (SEQ ID NO:30). Table 226 below describes the starting and ending position of this segment on each transcript.

TABLE 226

Segment location on transcripts

| Transcript name | Segment starting position | Segment ending position |
|---|---|---|
| H38804_PEA_1_T24 (SEQ ID NO:29) | 911 | 949 |
| H38804_PEA_1_T8 (SEQ ID NO:30) | 911 | 949 |

Segment cluster H38804_PEA_1_node_13 (SEQ ID NO:1183) according to the present invention is supported by 187 libraries. The number of libraries was determined as previously described. This segment can be found in the following transcript(s): H38804_PEA_1_T24 (SEQ ID NO:29) and H38804_PEA_1_T8 (SEQ ID NO:30). Table 227 below describes the starting and ending position of this segment on each transcript.

TABLE 227

Segment location on transcripts

| Transcript name | Segment starting position | Segment ending position |
|---|---|---|
| H38804_PEA_1_T24 (SEQ ID NO:29) | 950 | 1028 |
| H38804_PEA_1_T8 (SEQ ID NO:30) | 950 | 1028 |

Segment cluster H38804_PEA_1_node_14 (SEQ ID NO:1184) according to the present invention is supported by 179 libraries. The number of libraries was determined as previously described. This segment can be found in the following transcript(s): H38804_PEA_1_T24 (SEQ ID NO:29) and H38804_PEA_1_T8 (SEQ ID NO:30). Table 228 below describes the starting and ending position of this segment on each transcript.

TABLE 228

Segment location on transcripts

| Transcript name | Segment starting position | Segment ending position |
|---|---|---|
| H38804_PEA_1_T24 (SEQ ID NO:29) | 1029 | 1062 |
| H38804_PEA_1_T8 (SEQ ID NO:30) | 1029 | 1062 |

Segment cluster H38804_PEA_1_node_2 (SEQ ID NO:1185) according to the present invention is supported by 156 libraries. The number of libraries was determined as previously described. This segment can be found in the following transcript(s): H38804_PEA_1_T24 (SEQ ID NO:29) and H38804_PEA_1_T8 (SEQ ID NO:30). Table 229 below describes the starting and ending position of this segment on each transcript.

TABLE 229

Segment location on transcripts

| Transcript name | Segment starting position | Segment ending position |
|---|---|---|
| H38804_PEA_1_T24 (SEQ ID NO:29) | 646 | 678 |
| H38804_PEA_1_T8 (SEQ ID NO:30) | 646 | 678 |

Segment cluster H38804_PEA_1_node_20 (SEQ ID NO:1186) according to the present invention is supported by 162 libraries. The number of libraries was determined as previously described. This segment can be found in the following transcript(s): H38804_PEA_1_T24 (SEQ ID NO:29) and H38804_PEA_1_T8 (SEQ ID NO:30). Table 230 below describes the starting and ending position of this segment on each transcript.

TABLE 230

Segment location on transcripts

| Transcript name | Segment starting position | Segment ending position |
|---|---|---|
| H38804_PEA_1_T24 (SEQ ID NO:29) | 1361 | 1399 |
| H38804_PEA_1_T8 (SEQ ID NO:30) | 1361 | 1399 |

Segment cluster H38804_PEA_1_node_23 (SEQ ID NO:1187) according to the present invention can be found in the following transcript(s): H38804_PEA_1_T24 (SEQ ID NO:29) and H38804_PEA_1_T8 (SEQ ID NO:30). Table 231 below describes the starting and ending position of this segment on each transcript.

TABLE 231

Segment location on transcripts

| Transcript name | Segment starting position | Segment ending position |
|---|---|---|
| H38804_PEA_1_T24 (SEQ ID NO:29) | 1400 | 1420 |
| H38804_PEA_1_T8 (SEQ ID NO:30) | 1400 | 1420 |

Segment cluster H38804_PEA_1_node_26 (SEQ ID NO:1188) according to the present invention is supported by 21 libraries. The number of libraries was determined as previously described. This segment can be found in the following transcript(s): H38804_PEA_1_T8 (SEQ ID NO:30). Table 232 below describes the starting and ending position of this segment on each transcript.

TABLE 232

Segment location on transcripts

| Transcript name | Segment starting position | Segment ending position |
|---|---|---|
| H38804_PEA_1_T8 (SEQ ID NO:30) | 1970 | 2017 |

Segment cluster H38804_PEA_1_node_3 (SEQ ID NO:1189) according to the present invention is supported by 162 libraries. The number of libraries was determined as previously described. This segment can be found in the following transcript(s): H38804_PEA_1_T24 (SEQ ID NO:29) and H38804_PEA_1_T8 (SEQ ID NO:30). Table 233 below describes the starting and ending position of this segment on each transcript.

TABLE 233

Segment location on transcripts

| Transcript name | Segment starting position | Segment ending position |
|---|---|---|
| H38804_PEA_1_T24 (SEQ ID NO:29) | 679 | 716 |
| H38804_PEA_1_T8 (SEQ ID NO:30) | 679 | 716 |

Segment cluster H38804_PEA_1_node_4 (SEQ ID NO:1190) according to the present invention is supported by 172 libraries. The number of libraries was determined as previously described. This segment can be found in the following transcript(s): H38804_PEA_1_T24 (SEQ ID NO:29) and H38804_PEA_1_T8 (SEQ ID NO:30). Table 234 below describes the starting and ending position of this segment on each transcript.

TABLE 234

Segment location on transcripts

| Transcript name | Segment starting position | Segment ending position |
|---|---|---|
| H38804_PEA_1_T24 (SEQ ID NO:29) | 717 | 827 |
| H38804_PEA_1_T8 (SEQ ID NO:30) | 717 | 827 |

Segment cluster H38804_PEA_1_node_5 (SEQ ID NO:1191) according to the present invention can be found in the following transcript(s): H38804_PEA_1_T24 (SEQ ID NO:29) and H38804_PEA_1_T8 (SEQ ID NO:30). Table 235 below describes the starting and ending position of this segment on each transcript.

TABLE 235

Segment location on transcripts

| Transcript name | Segment starting position | Segment ending position |
|---|---|---|
| H38804_PEA_1_T24 (SEQ ID NO:29) | 828 | 840 |
| H38804_PEA_1_T8 (SEQ ID NO:30) | 828 | 840 |

Variant protein alignment to the previously known protein:

Sequence name: /tmp/RR4oV8zYLg/QlORqeqpIp: BUB3_HUMAN (SEQ ID NO:1424)

Sequence documentation:

Alignment of: H38804_PEA_1_P5 (SEQ ID NO:1307) x BUB3_HUMAN (SEQ ID NO:1424)

Alignment segment 1/1:

| Quality: | 3244.00 | Escore: | 0 |
|---|---|---|---|
| Matching length: | 324 | Total length: | 324 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 58 MTGSNEFKLNQPPEDGISSVKFSPNTSQFLLVSSWDTSVRLYDVPANSMR 107
    |||||||||||||||||||||||||||||||||||||||||||||||||
  1 MTGSNEFKLNQPPEDGISSVKFSPNTSQFLLVSSWDTSVRLYDVPANSMR  50

108 LKYQHTGAVLDCAFYDPTHAWSGGLDHQLKMHDLNTDQENLVGTHDAPIR 157
    |||||||||||||||||||||||||||||||||||||||||||||||||
 51 LKYQHTGAVLDCAFYDPTHAWSGGLDHQLKMHDLNTDQENLVGTHDAPIR 100

158 CVEYCPEVNVMVTGSWDQTVKLWDPRTPCNAGTFSQPEKVYTLSVSGDRL 207
    |||||||||||||||||||||||||||||||||||||||||||||||||
101 CVEYCPEVNVMVTGSWDQTVKLWDPRTPCNAGTFSQPEKVYTLSVSGDRL 150

208 IVGTAGRRVLVWDLRNMGYVQQRRESSLKYQTRCIRAFPNKQGYVLSSIE 257
    |||||||||||||||||||||||||||||||||||||||||||||||||
151 IVGTAGRRVLVWDLRNMGYVQQRRESSLKYQTRCIRAFPNKQGYVLSSIE 200

258 GRVAVEYLDPSPEVQKKKYAFKCHRLKENNIEQIYPVNAISFHNIHNTFA 307
    |||||||||||||||||||||||||||||||||||||||||||||||||
201 GRVAVEYLDPSPEVQKKKYAFKCHRLKENNIEQIYPVNAISFHNIHNTFA 250

308 TGGSDGFVNIWDPFNKKRLCQFHRYPTSIASLAFSNDGTTLAIASSYMYE 357
    |||||||||||||||||||||||||||||||||||||||||||||||||
251 TGGSDGFVNIWDPFNKKRLCQFHRYPTSIASLAFSNDGTTLAIASSYMYE 300

358 MDDTEHPEDGIFIRQVTDAETKPK                          381
    ||||||||||||||||||||||||
301 MDDTEHPEDGIFIRQVTDAETKPK                          324
```

Sequence name: /tmp/Db0dQEpSuo/Lr8HPXaeBg: BUB3_HUMAN (SEQ ID NO:1424)

Sequence documentation:

Alignment of: H38804_PEA_1_P17 (SEQ ID NO:1308) x BUB3_HUMAN (SEQ ID NO:1424) . . .

Alignment segment 1/1:

| Quality: | 3288.00 | Escore: | 0 |
|---|---|---|---|
| Matching length: | 328 | Total length: | 328 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 58 MTGSNEFKLNQPPEDGISSVKFSPNTSQFLLVSSWDTSVRLYDVPANSMR 107
    |||||||||||||||||||||||||||||||||||||||||||||||||
  1 MTGSNEFKLNQPPEDGISSVKFSPNTSQFLLVSSWDTSVRLYDVPANSMR 50

108 LKYQHTGAVLDCAFYDPTHAWSGGLDHQLKMHDLNTDQENLVGTHDAPIR 157
    |||||||||||||||||||||||||||||||||||||||||||||||||
 51 LKYQHTGAVLDCAFYDPTHAWSGGLDHQLKMHDLNTDQENLVGTHDAPIR 100

158 CVEYCPEVNVMVTGSWDQTVKLWDPRTPCNAGTFSQPEKVYTLSVSGDRL 207
    |||||||||||||||||||||||||||||||||||||||||||||||||
101 CVEYCPEVNVMVTGSWDQTVKLWDPRTPCNAGTFSQPEKVYTLSVSGDRL 150

208 IVGTAGRRVLVWDLRNMGYVQQRRESSLKYQTRCIRAFPNKQGYVLSSIE 257
    |||||||||||||||||||||||||||||||||||||||||||||||||
151 IVGTAGRRVLVWDLRNMGYVQQRRESSLKYQTRCIRAFPNKQGYVLSSIE 200

258 GRVAVEYLDPSPEVQKKKYAFKCHRLKENNIEQIYPVNAISFHNIHNTFA 307
    |||||||||||||||||||||||||||||||||||||||||||||||||
201 GRVAVEYLDPSPEVQKKKYAFKCHRLKENNIEQIYPVNAISFHNIHNTFA 250

308 TGGSDGFVNIWDPFNKKRLCQFHRYPTSIASLAFSNDGTTLAIASSYMYE 357
    |||||||||||||||||||||||||||||||||||||||||||||||||
251 TGGSDGFVNIWDPFNKKRLCQFHRYPTSIASLAFSNDGTTLAIASSYMYE 300

358 MDDTEHPEDGIFIRQVTDAETKPKSPCT                      385
    ||||||||||||||||||||||||||||
301 MDDTEHPEDGIFIRQVTDAETKPKSPCT                      328
```

Description for Cluster HSENA78

Cluster HSENA78 features 1 transcript(s) and 7 segment(s) of interest, the names for which are given in Tables 236 and 237, respectively, the sequences themselves are given at the end of the application. The selected protein variants are given in table 238.

TABLE 236

Transcripts of interest

| Transcript Name | Sequence ID No. |
|---|---|
| HSENA78_T5 | 31 |

TABLE 237

Segments of interest

| Segment Name | Sequence ID No. |
|---|---|
| HSENA78_node_0 | 398 |
| HSENA78_node_2 | 399 |
| HSENA78_node_6 | 400 |
| HSENA78_node_9 | 401 |
| HSENA78_node_3 | 402 |
| HSENA78_node_4 | 403 |
| HSENA78_node_8 | 404 |

TABLE 238

Proteins of interest

| Protein Name | Sequence ID No. |
|---|---|
| HSENA78_P2 | 1309 |

These sequences are variants of the known protein Small inducible cytokine B5 precursor (SwissProt accession identifier SZ05_HUMAN; known also according to the synonyms CXCL5; Epithelial-derived neutrophil activating protein 78; Neutrophil-activating peptide ENA-78), SEQ ID NO:1425, referred to herein as the previously known protein.

Protein Small inducible cytokine B5 precursor (SEQ ID NO:1425) is known or believed to have the following function(s): Involved in neutrophil activation. The sequence for protein Small inducible cytokine B5 precursor is given at the end of the application, as "Small inducible cytokine B5 precursor amino acid sequence". Protein Small inducible cytokine B5 precursor localization is believed to be Secreted.

The following GO Annotation(s) apply to the previously known protein. The following annotation(s) were found: chemotaxis; signal transduction; cell-cell signaling; positive control of cell proliferation, which are annotation(s) related to Biological Process; and chemokine, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HSENA78 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 24 refer to weighted expression of ESTs in each category, as "parts per million" (ratio of the expression of ESTs for a particular cluster to the expression of all ESTs in that category, according to parts per million).

Figure 24:
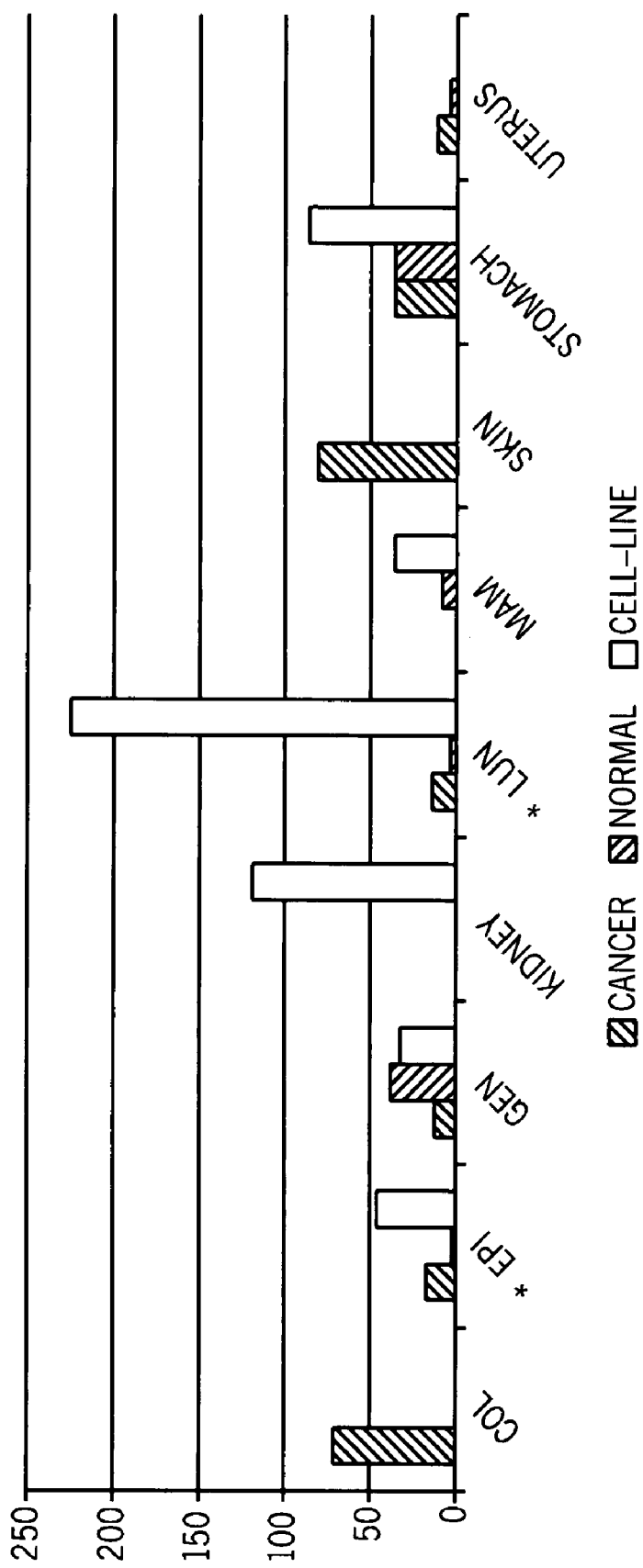
FIG. 24 is a histogram showing Cancer and cell-line vs. normal tissue expression for Cluster HSENA78, demonstrating overexpression in epithelial malignant tumors and lung malignant tumors.

Overall, the following results were obtained as shown with regard to the histograms in FIG. 24 and Table 239. This cluster is overexpressed (at least at a minimum level) in the following pathological conditions: epithelial malignant tumors and lung malignant tumors.

TABLE 239

Normal tissue distribution

| Name of Tissue | Number |
| --- | --- |
| colon | 0 |
| epithelial | 2 |
| general | 38 |
| kidney | 0 |
| lung | 3 |
| breast | 8 |
| skin | 0 |
| stomach | 36 |
| uterus | 4 |

TABLE 240

P values and ratios for expression in cancerous tissue

| Name of Tissue | P1 | P2 | SP1 | R3 | SP2 | R4 |
| --- | --- | --- | --- | --- | --- | --- |
| colon | 2.6e-01 | 3.3e-01 | 1.7e-01 | 2.7 | 2.7e-01 | 2.2 |
| epithelial | 2.5e-01 | 9.0e-02 | 3.2e-03 | 4.1 | 8.5e-07 | 5.5 |
| general | 8.4e-01 | 7.2e-01 | 1 | 0.3 | 1 | 0.4 |
| kidney | 1 | 7.2e-01 | 1 | 1.0 | 1.7e-01 | 1.9 |
| lung | 8.5e-01 | 4.8e-01 | 4.1e-01 | 1.9 | 4.0e-05 | 3.8 |
| breast | 9.5e-01 | 8.7e-01 | 1 | 0.8 | 6.8e-01 | 1.2 |
| skin | 2.9e-01 | 4.7e-01 | 1.4e-01 | 7.0 | 6.4e-01 | 1.6 |
| stomach | 5.0e-01 | 4.3e-01 | 7.5e-01 | 1.0 | 4.3e-01 | 1.3 |
| uterus | 7.1e-01 | 8.5e-01 | 6.6e-01 | 1.3 | 8.0e-01 | 1.0 |

As noted above, cluster HSENA78 features 1 transcript(s), which were listed in Table 236 above. These transcript(s) encode for protein(s) which are variant(s) of protein Small inducible cytokine B5 precursor (SEQ ID NO:1425). A description of each variant protein according to the present invention is now provided.

Variant protein HSENA78_P2 (SEQ ID NO:1309) according to the present invention has an amino acid sequence as given at the end of the application; it is encoded by transcript(s) HSENA78_T5 (SEQ ID NO:31). An alignment is given to the known protein (Small inducible cytokine B5 precursor (SEQ ID NO:1425)) at the end of the application.

One or more alignments to one or more previously published protein sequences are given at the end of the application. A brief description of the relationship of the variant protein according to the present invention to each such aligned protein is as follows:

Comparison report between HSENA78_P2 (SEQ ID NO:1309) and SZ05_HUMAN (SEQ ID NO:1425):

1. An isolated chimeric polypeptide encoding for HSENA78_P2 (SEQ ID NO:1309), comprising a first amino acid sequence being at least 90% homologous to MSLLSS-RAARVPGPSSSLCALLVLLLLLTQPGPI-ASAGPAAAVLRELRCVCLQTTQGVHPK-MISNLQVFAIG PQCSKVEVV corresponding to amino acids 1-81 of SZ05_HUMAN (SEQ ID NO:1425), which also corresponds to amino acids 1-81 of HSENA78_P2 (SEQ ID NO:1309).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSENA78_P2 (SEQ ID NO:1309) also has the following non-silent SNPs (Single Nucleotide Polymorphisms) as listed in Table 241, (given according to their position(s) on the amino acid sequence, with the alternative amino acid(s) listed; the last column indicates whether the SNP is known or not; the presence of known SNPs in variant protein HSENA78_P2 (SEQ ID NO:1309) sequence provides support for the deduced sequence of this variant protein according to the present invention).

TABLE 241

Amino acid mutations

| SNP position(s) on amino acid sequence | Alternative amino acid(s) | Previously known SNP? |
| --- | --- | --- |
| 80 | V -> | No |
| 81 | V -> | No |

Variant protein HSENA78_P2 (SEQ ID NO:1309) is encoded by the following transcript(s): HSENA78_T5 (SEQ ID NO:31), for which the sequence(s) is/are given at the end of the application. The coding portion of transcript HSENA78_T5 (SEQ ID NO:31) is shown in bold; this coding portion starts at position 149 and ends at position 391. The transcript also has the following SNPs as listed in Table 242 (given according to their position on the nucleotide sequence, with the alternative nucleic acid listed; the last column indicates whether the SNP is known or not; the presence of known SNPs in variant protein HSENA78_P2 (SEQ ID NO:1309) sequence provides support for the deduced sequence of this variant protein according to the present invention).

TABLE 242

Nucleic acid SNPs

| SNP position on nucleotide sequence | Alternative nucleic acid | Previously known SNP? |
| --- | --- | --- |
| 92 | C -> T | Yes |
| 144 | C -> T | No |
| 1151 | A -> T | Yes |
| 1389 | T -> C | No |

TABLE 242-continued

Nucleic acid SNPs

| SNP position on nucleotide sequence | Alternative nucleic acid | Previously known SNP? |
|---|---|---|
| 1867 | C -> G | Yes |
| 145 | C -> T | No |
| 181 | C -> T | Yes |
| 316 | G -> A | Yes |
| 388 | G -> | No |
| 390 | T -> | No |
| 605 | T -> | No |
| 972 | C -> T | Yes |
| 1105 | A -> G | Yes |

As noted above, cluster HSENA78 features 7 segment(s), which were listed in Table 237 above and for which the sequence(s) are given at the end of the application. These segment(s) are portions of nucleic acid sequence(s) which are described herein separately because they are of particular interest. A description of each segment according to the present invention is now provided.

Segment cluster HSENA78_node_0 (SEQ ID NO:1192) according to the present invention is supported by 24 libraries. The number of libraries was determined as previously described. This segment can be found in the following transcript(s): HSENA78_T5 (SEQ ID NO:31). Table 243 below describes the starting and ending position of this segment on each transcript.

TABLE 243

Segment location on transcripts

| Transcript name | Segment starting position | Segment ending position |
|---|---|---|
| HSENA78_T5 (SEQ ID NO:31) | 1 | 257 |

Segment cluster HSENA78_node_2 (SEQ ID NO:1193) according to the present invention is supported by 22 libraries. The number of libraries was determined as previously described. This segment can be found in the following transcript(s): HSENA78_T5 (SEQ ID NO:31). Table 244 below describes the starting and ending position of this segment on each transcript.

TABLE 244

Segment location on transcripts

| Transcript name | Segment starting position | Segment ending position |
|---|---|---|
| HSENA78_T5 (SEQ ID NO:31) | 258 | 390 |

Segment cluster HSENA78_node_6 (SEQ ID NO:1194) according to the present invention is supported by 68 libraries. The number of libraries was determined as previously described. This segment can be found in the following transcript(s): HSENA78_T5 (SEQ ID NO:31). Table 245 below describes the starting and ending position of this segment on each transcript.

TABLE 245

Segment location on transcripts

| Transcript name | Segment starting position | Segment ending position |
|---|---|---|
| HSENA78_T5 (SEQ ID NO:31) | 585 | 2370 |

Segment cluster HSENA78_node_9 (SEQ ID NO:1195) according to the present invention is supported by 28 libraries. The number of libraries was determined as previously described. This segment can be found in the following transcript(s): HSENA78_T5 (SEQ ID NO:31). Table 246 below describes the starting and ending position of this segment on each transcript.

TABLE 246

Segment location on transcripts

| Transcript name | Segment starting position | Segment ending position |
|---|---|---|
| HSENA78_T5 (SEQ ID NO:31) | 2394 | 2546 |

According to an optional embodiment of the present invention, short segments related to the above cluster are also provided. These segments are up to about 120 bp in length, and so are included in a separate description.

Segment cluster HSENA78_node_3 (SEQ ID NO:1196) according to the present invention is supported by 1 libraries. The number of libraries was determined as previously described. This segment can be found in the following transcript(s): HSENA78_T5 (SEQ ID NO:31). Table 247 below describes the starting and ending position of this segment on each transcript.

TABLE 247

Segment location on transcripts

| Transcript name | Segment starting position | Segment ending position |
|---|---|---|
| HSENA78_T5 (SEQ ID NO:31) | 391 | 500 |

Segment cluster HSENA78_node_4 (SEQ ID NO:1197) according to the present invention is supported by 17 libraries. The number of libraries was determined as previously described. This segment can be found in the following transcript(s): HSENA78_T5 (SEQ ID NO:31). Table 248 below describes the starting and ending position of this segment on each transcript.

TABLE 248

Segment location on transcripts

| Transcript name | Segment starting position | Segment ending position |
|---|---|---|
| HSENA78_T5 (SEQ ID NO:31) | 501 | 584 |

Segment cluster HSENA78_node_8 (SEQ ID NO:1198) according to the present invention can be found in the following transcript(s): HSENA78_T5 (SEQ ID NO:31). Table 249 below describes the starting and ending position of this segment on each transcript.

TABLE 249

| Segment location on transcripts | | |
|---|---|---|
| Transcript name | Segment starting position | Segment ending position |
| HSENA78_T5 (SEQ ID NO:31) | 2371 | 2393 |

Variant protein alignment to the previously known protein:

Sequence name: /tmp/5kiQY6MxWx/pLnTrxsCqk: SZ05_HUMAN (SEQ ID NO:1425)

Sequence documentation:

Alignment of: HSENA78_P2 (SEQ ID NO:1309) x SZ05_HUMAN (SEQ ID NO:1425)

Alignment segment 1/1:

| | |
|---|---|
| Quality: 767.00 | Escore: 0 |
| Matching length: 81 | Total length: 81 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MSLLSSRAARVPGPSSSLCALLVLLLLLTQPGPIASAGPAAAVLRELRCV 50
    |||||||||||||||||||||||||||||||||||||||||||||||||
  1 MSLLSSRAARVPGPSSSLCALLVLLLLLTQPGPIASAGPAAAVLRELRCV 50

51 CLQTTQGVHPKMISNLQVFAIGPQCSKVEVV                    81
    |||||||||||||||||||||||||||||||
 51 CLQTTQGVHPKMISNLQVFAIGPQCSKVEVV                    81
```

Description for Cluster HUMODCA

Cluster HUMODCA features 1 transcript(s) and 17 segment(s) of interest, the names for which are given in Tables 250 and 251, respectively, the sequences themselves are given at the end of the application. The selected protein variants are given in table 252.

TABLE 250

| Transcripts of interest | |
|---|---|
| Transcript name | Sequence ID No. |
| HUMODCA_T17 | 32 |

TABLE 251

| Segments of interest | |
|---|---|
| Sequence Name | Sequence ID No. |
| HUMODCA_node_1 | 405 |
| HUMODCA_node_25 | 406 |
| HUMODCA_node_32 | 407 |
| HUMODCA_node_36 | 408 |
| HUMODCA_node_39 | 409 |
| HUMODCA_node_41 | 410 |
| HUMODGA_node_0 | 411 |

TABLE 251-continued

| Segments of interest | |
|---|---|
| Sequence Name | Sequence ID No. |
| HUMODCA_node_10 | 412 |
| HUMODGA_node_12 | 413 |
| HUMODCA_node_13 | 414 |
| HUMODCA_node_2 | 415 |
| HUMODCA_node_27 | 416 |
| HUMODCA_node_3 | 417 |
| HUMODCA_node_30 | 418 |
| HUMODCA_node_34 | 419 |
| HUMODCA_node_38 | 420 |
| HUMODCA_node_40 | 421 |

TABLE 252

| Proteins of interest | |
|---|---|
| Protein Name | Sequence ID No. |
| HUMODCA_P9 | 1310 |

These sequences are variants of the known protein Ornithine decarboxylase (SwissProt accession identifier DCOR_HUMAN; known also according to the synonyms EC 4.1.1.17; ODC), SEQ ID NO:1426, referred to herein as the previously known protein.

Protein Ornithine decarboxylase (SEQ ID NO:1426) is known or believed to have the following function(s): Polyamine biosynthesis; first (rate-limiting) step. The sequence for protein Ornithine decarboxylase (SEQ ID NO:1426) is given at the end of the application, as "Ornithine decarboxylase (SEQ ID NO:1426) amino acid sequence". Known polymorphisms for this sequence are as shown in Table 253.

TABLE 253

| Amino acid mutations for Known Protein | |
|---|---|
| SNP position(s) on amino acid sequence | Comment |
| 415 | Q -> E |

The following GO Annotation(s) apply to the previously known protein. The following annotation(s) were found: polyamine biosynthesis, which are annotation(s) related to Biological Process; and ornithine decarboxylase; lyase, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HUMODCA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 25 refer to weighted expression of ESTs in each category, as "parts per million" (ratio of the expression of ESTs for a particular cluster to the expression of all ESTs in that category, according to parts per million).

Figure 25:
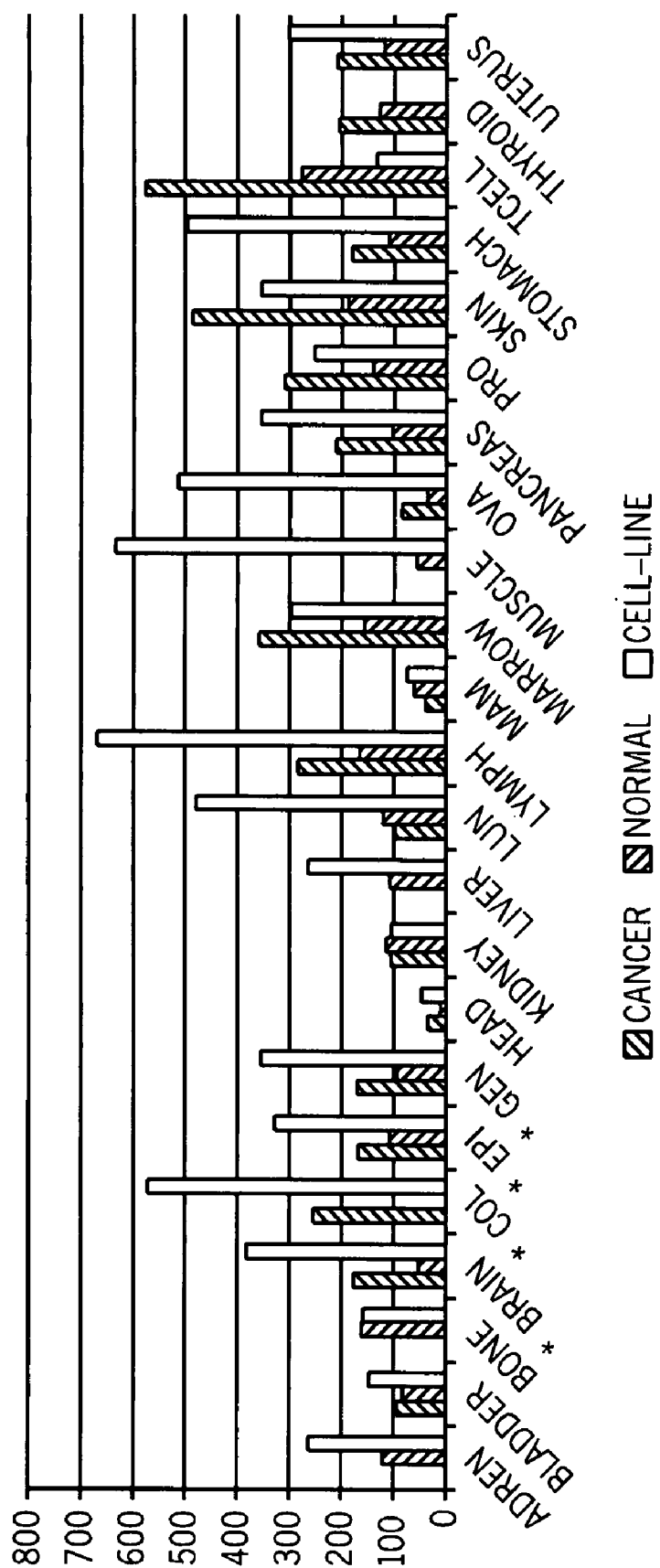
FIG. 25 is a histogram showing Cancer and cell-line vs. normal tissue expression for Cluster HUMODCA, demonstrating overexpression in: brain malignant tumors, colorectal cancer, epithelial malignant tumors and a mixture of malignant tumors from different tissues.

Overall, the following results were obtained as shown with regard to the histograms in FIG. 25 and Table 254. This cluster is overexpressed (at least at a minimum level) in the following pathological conditions: brain malignant tumors, colorectal cancer, epithelial malignant tumors and a mixture of malignant tumors from different tissues.

TABLE 254

Normal tissue distribution

| Name of Tissue | Number |
| --- | --- |
| adrenal | 120 |
| bladder | 82 |
| bone | 161 |
| brain | 53 |
| colon | 0 |
| epithelial | 107 |
| general | 94 |
| head and neck | 10 |
| kidney | 114 |
| liver | 107 |
| lung | 120 |
| lymph nodes | 165 |
| breast | 61 |
| bone marrow | 156 |
| muscle | 55 |
| ovary | 36 |
| pancreas | 102 |
| prostate | 140 |
| skin | 188 |
| stomach | 109 |
| T cells | 278 |
| Thyroid | 128 |
| uterus | 118 |

TABLE 255

P values and ratios for expression in cancerous tissue

| Name of Tissue | P1 | P2 | SP1 | R3 | SP2 | R4 |
| --- | --- | --- | --- | --- | --- | --- |
| adrenal | 8.3e−01 | 7.8e−01 | 1 | 0.2 | 8.5e−01 | 0.7 |
| bladder | 5.4e−01 | 5.1e−01 | 6.2e−01 | 1.1 | 5.0e−01 | 1.1 |
| bone | 8.3e−01 | 3.2e−01 | 1 | 0.2 | 8 4e−01 | 0.7 |
| brain | 2.6e−01 | 3.8e−02 | 6.5e−04 | 2.8 | 8.7e−10 | 3.6 |
| colon | 2.2e−02 | 5.8e−03 | 1.5e−03 | 6.9 | 6.7e−05 | 9.9 |
| epithelial | 6.4e−02 | 2.7e−03 | 1.4e−03 | 1.5 | 1.6e−12 | 2.1 |
| general | 1.3e−03 | 5.4e−08 | 1.9e−08 | 1.7 | 1.4e−39 | 2.6 |
| head and neck | 1.7e−01 | 1.7e−01 | 1 | 1.2 | 7.5e−01 | 1.3 |
| kidney | 7.7e−01 | 7.6e−01 | 7.1e−01 | 0.8 | 6.6e−01 | 0.9 |
| liver | 7.3e−01 | 5.7e−01 | 1 | 0.3 | 2.4e−01 | 1.2 |
| lung | 7.8e−01 | 5.8e−01 | 7.6e−01 | 0.6 | 7.3e−04 | 1.7 |
| lymph nodes | 3.9e−01 | 2.5e−01 | 1.8e−01 | 1.1 | 1.4e−04 | 2.1 |
| breast | 7.8e−01 | 4.7e−01 | 7.7e−01 | 0.8 | 6.4e−01 | 1.0 |
| bone marrow | 3.4e−01 | 2.6e−01 | 2.8e−01 | 2.1 | 1.6e−01 | 1.2 |
| muscle | 8.5e−01 | 6.1e−01 | 1 | 0.2 | 7.1e−05 | 1.0 |
| ovary | 1.7e−01 | 9.3e−02 | 3.8e−01 | 1.7 | 2.2e−02 | 2.6 |
| pancreas | 2.2e−01 | 3.2e−01 | 5.7e−02 | 1.6 | 6.6e−03 | 1.5 |
| prostate | 5.0e−01 | 4.9e−01 | 3.8e−02 | 1.9 | 4.5e−02 | 1.7 |
| skin | 6.2e−01 | 5.8e−01 | 5.4e−02 | 0.9 | 1.5e−02 | 0.5 |
| stomach | 4.2e−01 | 2.6e−01 | 3.7e−01 | 0.7 | 7.3e−03 | 2.3 |

TABLE 255-continued

P values and ratios for expression in cancerous tissue

| Name of Tissue | P1 | P2 | SP1 | R3 | SP2 | R4 |
| --- | --- | --- | --- | --- | --- | --- |
| T cells | 1 | 1 | 5.5e−01 | 1.5 | 8.1e−01 | 0.9 |
| Thyroid | 8.3e−02 | 8.3e−02 | 5.9e−01 | 1.3 | 5.9e−01 | 1.3 |
| uterus | 4.2e−01 | 2.4e−01 | 1.6e−01 | 1.2 | 4.9e−02 | 1.7 |

As noted above, cluster HUMODCA features 1 transcript(s), which were listed in Table 250 above. These transcript(s) encode for protein(s) which are variant(s) of protein Ornithine decarboxylase (SEQ ID NO:1426). A description of each variant protein according to the present invention is now provided.

Variant protein HUMODCA_P9 (SEQ ID NO:1310) according to the present invention has an amino acid sequence as given at the end of the application; it is encoded by transcript(s) HUMODCA_T17 (SEQ ID NO:32). An alignment is given to the known protein (Ornithine decarboxylase (SEQ ID NO:1426)) at the end of the application. One or more alignments to one or more previously published protein sequences are given at the end of the application. A brief description of the relationship of the variant protein according to the present invention to each such aligned protein is as follows:

Comparison report between HUMODCA_P9 (SEQ ID NO:1310) and DCOR_HUMAN (SEQ ID NO:1426):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTFWTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSRLLLERAKELNIDVVGVSFHVGSGCTDPETFVQAISDARCVFDM GAEVGFSMYLLDIGGGFPGSEDVKLKFEEITGVINPALDKYFPSDSGVRIIAEPGRYYVASAFTLAVNIIAKK IVLKEQTGSDDEDESSEQTFMYYVNDGVYGSFNCILYDHAHVKPLLQKRPKPDEKYYSSSIWGPTCDGLD RIVERCDLPEMHVGDWMLFENMGAYTVAAASTFNGFQRPTIYYVMSGPAWQLMQQFQNPDFPPEVEEQ DASTLPVSCAWESGMKRHRAACASASINV corresponding to amino acids 151-461 of DCOR_HUMAN (SEQ ID NO:1426), which also corresponds to amino acids 30-340 of HUMODCA_P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO:1768) of HUMODCA_P9 (SEQ ID NO:1310).

Comparison report between HUMODCA_P9 (SEQ ID NO:1310) and AAA59968 (SEQ ID NO:1702):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTF-WTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFVQAIS-DARCVFDM GAEVGFSMYLLDIGGGFPGSEDVKLK-FEEITGVINPALDKYFPSDSGVRIIAEPGRYYVASAF-TLAVNIIAKK IVLKEQTGSDDEDESSEQTFMYYVND-GVYGSFNCILYDHAHVKPLLQKRPKPDEKYYSSSI-WGPTCDGLD RIVERCDLPEMHVGDWMLFENMGAY-TVAAASTFNGFQRPTIYYVMSGPAWQLMQQFQNP-DFPPEVEEQ DASTLPVSCAWESGMKRHRAACASAS-INV corresponding to amino acids 40-350 of AAA59968, which also corresponds to amino acids 30-340 of HUMODCA P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO: 1768) of HUMODCA_P9 (SEQ ID NO:1310).

Comparison report between HUMODCA_P9 (SEQ ID NO:1310) and AAH14562 (SEQ ID NO:1703):

1. An isolated chimeric polypeptide encoding for HUMODCA_P9 (SEQ ID NO:1310), comprising a first amino acid sequence being at least 70%, optionally at least 80%, preferably at least 85%, more preferably at least 90% and most preferably at least 95% homologous to a polypeptide having the sequence MKSLTATSSMKVLLPRTF-WTRKLMKFLLL (SEQ ID NO: 1768) corresponding to amino acids 1-29 of HUMODCA_P9 (SEQ ID NO:1310), and a second amino acid sequence being at least 90% homologous to LVLRIATDDSKAVCRLSVKFGATLRTSR-LLLERAKELNIDVVGVSFHVGSGCTDPETFVQAIS-DARCVFDM GAEVGFSMYLLDIGGGFPGSEDVKLK-FEEITGVINPALDKYFPSDSGVRIIAEPGRYYVASAFT-LAVNIIAKK IVLKEQTGSDDEDESSEQT-FMYYVNDGVYGSFNCILYDHAHVKPLLQKRPKP-DEKYYSSSIWGPTCDGLD RIVERCDLPEMHVGDWM-LFENMGAYTVAAASTFNGFQRPTIYYVMSGPA-WQLMQQFQNPDFPPEVEEQ DASTLPVSCAWESG-MKRHRAACASASINV corresponding to amino acids 86-396 of AAH14562 (SEQ ID NO:1703), which also corresponds to amino acids 30-340 of HUMODCA_P9 (SEQ ID NO:1310), wherein said first and second amino acid sequences are contiguous and in a sequential order.

2. An isolated polypeptide encoding for a head of HUMODCA_P9 (SEQ ID NO:1310), comprising a polypeptide being at least 70%, optionally at least about 80%, preferably at least about 85%, more preferably at least about 90% and most preferably at least about 95% homologous to the sequence MKSLTATSSMKVLLPRTFWTRKLMKFLLL (SEQ ID NO: 1768) of HUMODCA_P9 (SEQ ID NO:1310).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMODCA_P9 (SEQ ID NO:1310) also has the following non-silent SNPs (Single Nucleotide Polymorphisms) as listed in Table 256, (given according to their position(s) on the amino acid sequence, with the alternative amino acid(s) listed; the last column indicates whether the SNP is known or not; the presence of known SNPs in variant protein HUMODCA_P9 (SEQ ID NO:1310) sequence provides support for the deduced sequence of this variant protein according to the present invention).

TABLE 256

Amino acid mutations

| SNP position(s) on amino acid sequence | Alternative amino acid(s) | Previously known SNP? |
|---|---|---|
| 150 | I -> S | No |
| 150 | I -> V | No |
| 262 | F -> L | No |
| 263 | E -> | No |
| 263 | E -> G | No |
| 30 | L -> | No |
| 301 | N -> | No |
| 301 | N -> K | No |
| 309 | E -> K | No |
| 312 | D -> N | No |
| 323 | E -> K | No |
| 329 | H -> P | No |
| 174 | I -> | No |
| 34 | I -> | No |
| 59 | L -> | No |
| 70 | V -> | No |
| 86 | T -> | No |
| 86 | T -> N | No |
| 90 | A -> | No |
| 94 | A -> | No |
| 97 | V -> | No |
| 97 | V -> G | No |
| 198 | N -> D | No |
| 200 | G -> | No |
| 3 | S -> | No |
| 207 | G -> G | No |
| 207 | C -> R | No |
| 223 | P -> | No |
| 262 | F -> | No |

Variant protein HUMODCA_P9 (SEQ ID NO:1310) is encoded by the following transcript(s): HUMODCA_T17 (SEQ ID NO:32), for which the sequence(s) is/are given at the end of the application. The coding portion of transcript HUMODCA_T17 (SEQ ID NO:32) is shown in bold; this coding portion starts at position 528 and ends at position 1547. The transcript also has the following SNPs as listed in Table 257 (given according to their position on the nucleotide sequence, with the alternative nucleic acid listed; the last column indicates whether the SNP is known or not; the presence of known SNPs in variant protein HUMODCA_P9 (SEQ ID NO:1310) sequence provides support for the deduced sequence of this variant protein according to the present invention).

TABLE 257

Nucleic acid SNPs

| SNP position on nucleotide sequence | Alternative nucleic acid | Previously known SNP? |
|---|---|---|
| 28 | C -> G | Yes |
| 210 | C -> | No |
| 536 | T -> | No |
| 615 | T -> | No |
| 628 | T -> | No |
| 703 | T -> | No |

TABLE 257-continued

Nucleic acid SNPs

| SNP position on nucleotide sequence | Alternative nucleic acid | Previously known SNP? |
|---|---|---|
| 736 | T -> | No |
| 784 | C -> | No |
| 784 | C -> A | No |
| 797 | A -> | No |
| 797 | A -> T | No |
| 808 | C -> | No |
| 217 | C -> | No |
| 817 | T -> | No |
| 817 | T -> G | No |
| 869 | C -> T | Yes |
| 975 | A -> G | No |
| 976 | T -> G | No |
| 1048 | T -> | No |
| 1119 | A -> G | No |
| 1127 | C -> | No |
| 1127 | C -> G | No |
| 1146 | T -> C | No |
| 366 | G -> C | No |
| 1146 | T -> G | No |
| 1194 | C -> | No |
| 1283 | T -> C | Yes |
| 1311 | T -> | No |
| 1311 | T -> C | No |
| 1315 | A -> | No |
| 1315 | A -> G | No |
| 1430 | C -> | No |
| 1430 | C -> A | No |
| 1433 | C -> G | No |
| 366 | G -> T | No |
| 1452 | G -> A | No |
| 1461 | G -> A | No |
| 1494 | G -> A | No |
| 1513 | A -> C | No |
| 1632 | T -> | No |
| 1673 | C -> | No |
| 1739 | T -> | No |
| 1739 | T -> G | No |
| 1742 | T -> C | No |
| 447 | G -> A | Yes |
| 1786 | C -> | No |
| 1786 | C -> G | No |
| 1832 | T -> C | Yes |
| 1877 | C -> T | No |
| 464 | T -> G | Yes |
| 473 | A -> G | Yes |
| 506 | G -> A | Yes |
| 521 | T -> | No |

As noted above, cluster HUMODCA features 17 segment(s), which were listed in Table 251 above and for which the sequence(s) are given at the end of the application. These segment(s) are portions of nucleic acid sequence(s) which are described herein separately because they are of particular interest. A description of each segment according to the present invention is now provided.

Segment cluster HUMODCA_node_1 (SEQ ID NO:1199) according to the present invention is supported by 76 libraries. The number of libraries was determined as previously described. This segment can be found in the following transcript(s): HUMODCA_T17 (SEQ ID NO:32). Table 258 below describes the starting and ending position of this segment on each transcript.

TABLE 258

| | Segment location on transcripts | |
|---|---|---|
| Transcript name | Segment starting position | Segment ending position |
| HUMODCA_T17 (SEQ ID NO:32) | 118 | 256 |

Segment cluster HUMODCA_node_25 (SEQ ID NO:1200) according to the present invention is supported by 190 libraries. The number of libraries was determined as previously described. This segment can be found in the following transcript(s): HUMODCA_T17 (SEQ ID NO:32). Table 259 below describes the starting and ending position of this segment on each transcript.

TABLE 259

| | Segment location on transcripts | |
|---|---|---|
| Transcript name | Segment starting position | Segment ending position |
| HUMODCA_T17 (SEQ ID NO:32) | 614 | 748 |

Segment cluster HUMODCA_node_32 (SEQ ID NO:1201) according to the present invention is supported by 249 libraries. The number of libraries was determined as previously described. This segment can be found in the following transcript(s): HUMODCA_T17 (SEQ ID NO:32). Table 260 below describes the starting and ending position of this segment on each transcript.

TABLE 260

| | Segment location on transcripts | |
|---|---|---|
| Transcript name | Segment starting position | Segment ending position |
| HUMODCA_T17 (SEQ ID NO:32) | 915 | 1077 |

Segment cluster HUMODCA_node_36 (SEQ ID NO:1202) according to the present invention is supported by 348 libraries. The number of libraries was determined as previously described. This segment can be found in the following transcript(s): HUMODCA_T17 (SEQ ID NO:32). Table 261 below describes the starting and ending position of this segment on each transcript.

TABLE 261

| | Segment location on transcripts | |
|---|---|---|
| Transcript name | Segment starting position | Segment ending position |
| HUMODCA_T17 (SEQ ID NO:32) | 1191 | 1405 |

Segment cluster HUMODCA_node_39 (SEQ ID NO:1203) according to the present invention is supported by 297 libraries. The number of libraries was determined as previously described. This segment can be found in the following transcript(s): HUMODCA_T17 (SEQ ID NO:32). Table 262 below describes the starting and ending position of this segment on each transcript.

TABLE 262

Segment location on transcripts

| Transcript name | Segment starting position | Segment ending position |
|---|---|---|
| HUMODCA_T17 (SEQ ID NO:32) | 1461 | 1633 |

Segment cluster HUMODCA_node_41 (SEQ ID NO:1204) according to the present invention is supported by 230 libraries. The number of libraries was determined as previously described. This segment can be found in the following transcript(s): HUMODCA_T17 (SEQ ID NO:32). Table 263 below describes the starting and ending position of this segment on each transcript.

TABLE 263

Segment location on transcripts

| Transcript name | Segment starting position | Segment ending position |
|---|---|---|
| HUMODCA_T17 (SEQ ID NO:32) | 1728 | 1893 |

According to an optional embodiment of the present invention, short segments related to the above cluster are also provided. These segments are up to about 120 bp in length, and so are included in a separate description.

Segment cluster HUMODCA_node_0 (SEQ ID NO:1205) according to the present invention is supported by 9 libraries. The number of libraries was determined as previously described. This segment can be found in the following transcript(s): HUMODCA_T17 (SEQ ID NO:32). Table 264 below describes the starting and ending position of this segment on each transcript.

TABLE 264

Segment location on transcripts

| Transcript name | Segment starting position | Segment ending position |
|---|---|---|
| HUMODCA_T17 (SEQ ID NO:32) | 1 | 117 |

Segment cluster HUMODCA_node_10 (SEQ ID NO:1206) according to the present invention is supported by 107 libraries. The number of libraries was determined as previously described. This segment can be found in the following transcript(s): HUMODCA_T17 (SEQ ID NO:32). Table 265 below describes the starting and ending position of this segment on each transcript.

TABLE 265

Segment location on transcripts

| Transcript name | Segment starting position | Segment ending position |
|---|---|---|
| HUMODCA_T17 (SEQ ID NO:32) | 385 | 494 |

Segment cluster HUMODCA_node_12 (SEQ ID NO:1207) according to the present invention is supported by 132 libraries. The number of libraries was determined as previously described. This segment can be found in the following transcript(s): HUMODCA_T17 (SEQ ID NO:32). Table 266 below describes the starting and ending position of this segment on each transcript.

TABLE 266

Segment location on transcripts

| Transcript name | Segment starting position | Segment ending position |
|---|---|---|
| HUMODCA_T17 (SEQ ID NO:32) | 495 | 586 |

Segment cluster HUMODCA_node_13 (SEQ ID NO:1208) according to the present invention is supported by 126 libraries. The number of libraries was determined as previously described. This segment can be found in the following transcript(s): HUMODCA_T17 (SEQ ID NO:32). Table 267 below describes the starting and ending position of this segment on each transcript.

TABLE 267

Segment location on transcripts

| Transcript name | Segment starting position | Segment ending position |
|---|---|---|
| HUMODCA_T17 (SEQ ID NO:32) | 587 | 613 |

Segment cluster HUMODCA_node_2 (SEQ ID NO:1209) according to the present invention is supported by 81 libraries. The number of libraries was determined as previously described. This segment can be found in the following transcript(s): HUMODCA_T17 (SEQ ID NO:32). Table 268 below describes the starting and ending position of this segment on each transcript.

TABLE 268

Segment location on transcripts

| Transcript name | Segment starting position | Segment ending position |
|---|---|---|
| HUMODCA_T17 (SEQ ID NO:32) | 257 | 328 |

Segment cluster HUMODCA_node_27 (SEQ ID NO:1210) according to the present invention is supported by 185 libraries. The number of libraries was determined as previously described. This segment can be found in the following transcript(s): HUMODCA_T17 (SEQ ID NO:32). Table 269 below describes the starting and ending position of this segment on each transcript.

TABLE 269

Segment location on transcripts

| Transcript name | Segment starting position | Segment ending position |
|---|---|---|
| HUMODCA_T17 (SEQ ID NO:32) | 749 | 830 |

Segment cluster HUMODCA_node_3 (SEQ ID NO:1211) according to the present invention is supported by 85 libraries. The number of libraries was determined as previously described. This segment can be found in the following transcript(s): HUMODCA_T17 (SEQ ID NO:32). Table 270 below describes the starting and ending position of this segment on each transcript.

TABLE 270

| Segment location on transcripts | | |
|---|---|---|
| Transcript name | Segment starting position | Segment ending position |
| HUMODCA_T17 (SEQ ID NO:32) | 329 | 384 |

Segment cluster HUMODCA_node_30 (SEQ ID NO:1212) according to the present invention is supported by 196 libraries. The number of libraries was determined as previously described. This segment can be found in the following transcript(s): HUMODCA_T17 (SEQ ID NO:32). Table 271 below describes the starting and ending position of this segment on each transcript.

TABLE 271

| Segment location on transcripts | | |
|---|---|---|
| Transcript name | Segment starting position | Segment ending position |
| HUMODCA_T17 (SEQ ID NO:32) | 831 | 914 |

Segment cluster HUMODCA_node_34 (SEQ ID NO:1213) according to the present invention is supported by 259 libraries. The number of libraries was determined as previously described. This segment can be found in the following transcript(s): HUMODCA_T17 (SEQ ID NO:32). Table 272 below describes the starting and ending position of this segment on each transcript.

TABLE 272

| Segment location on transcripts | | |
|---|---|---|
| Transcript name | Segment starting position | Segment ending position |
| HUMODCA_T17 (SEQ ID NO:32) | 1078 | 1190 |

Segment cluster HUMODCA_node_38 (SEQ ID NO:1214) according to the present invention is supported by 272 libraries. The number of libraries was determined as previously described. This segment can be found in the following transcript(s): HUMODCA_T17 (SEQ ID NO:32). Table 273 below describes the starting and ending position of this segment on each transcript.

TABLE 273

| Segment location on transcripts | | |
|---|---|---|
| Transcript name | Segment starting position | Segment ending position |
| HUMODCA_T17 (SEQ ID NO:32) | 1406 | 1460 |

Segment cluster HUMODCA_node_40 (SEQ ID NO:1215) according to the present invention is supported by 239 libraries. The number of libraries was determined as previously described. This segment can be found in the following transcript(s): HUMODCA_T17 (SEQ ID NO:32). Table 274 below describes the starting and ending position of this segment on each transcript.

TABLE 274

| Segment location on transcripts | | |
|---|---|---|
| Transcript name | Segment starting position | Segment ending position |
| HUMODCA_T17 (SEQ ID NO:32) | 1634 | 1727 |

Variant protein alignment to the previously known protein:

Sequence name: /tmp/y03EwE6i01/dRQ5l2K6e2: DCOR_HUMAN (SEQ ID NO:1426)

Sequence documentation:

Alignment of: HUMODCA_P9 (SEQ ID NO:1310) x DCOR_HUMAN (SEQ ID NO:1426)

Alignment segment 1/1:

| | |
|---|---|
| Quality: 3056.00 | Escore: 0 |
| Matching length: 311 | Total length: 311 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 30 LVLRIATDDSKAVCRLSVKFGATLRTSRLLLERAKELNIDVVGVSFHVGS  79
    |||||||||||||||||||||||||||||||||||||||||||||||||
151 LVLRIATDDSKAVCRLSVKFGATLRTSRLLLERAKELNIDVVGVSFHVGS 200

80 GCTDPETFVQAISDARCVFDMGAEVGFSMYLLDIGGGFPGSEDVKLKFEE 129
    |||||||||||||||||||||||||||||||||||||||||||||||||
201 GCTDPETFVQAISDARCVFDMGAEVGFSMYLLDIGGGFPGSEDVKLKFEE 250

130 ITGVINPALDKYFPSDSGVRIIAEPGRYYVASAFTLAVNIIAKKIVLKEQ 179
    |||||||||||||||||||||||||||||||||||||||||||||||||
251 ITGVINPALDKYFPSDSGVRIIAEPGRYYVASAFTLAVNIIAKKIVLKEQ 300

180 TGSDDEDESSEQTFMYYVNDGVYGSFNCILYDHAHVKPLLQKRPKPDEKY 229
    |||||||||||||||||||||||||||||||||||||||||||||||||
301 TGSDDEDESSEQTFMYYVNDGVYGSFNCILYDHAHVKPLLQKRPKPDEKY 350

230 YSSSIWGPTCDGLDRIVERCDLPEMHVGDWMLFENMGAYTVAAASTFNGF 279
    |||||||||||||||||||||||||||||||||||||||||||||||||
351 YSSSIWGPTCDGLDRIVERCDLPEMHVGDWMLFENMGAYTVAAASTFNGF 400

280 QRPTIYYVMSGPAWQLMQQFQNPDFPPEVEEQDASTLPVSCAWESGMKRH 329
    |||||||||||||||||||||||||||||||||||||||||||||||||
401 YSSSIWGPTCDGLDRIVERCDLPEMHVGDWMLFENMGAYTVAAASTFNGF 450
```

-continued

```
330 RAACASASINV            340
    |||||||||||
451 RAACASASINV            461
```

Sequence name: /tmp/y03EwE6i01/dRQ5l2K6e2: AAA59968

Sequence documentation:

Alignment of: HUMODCA_P9 (SEQ ID NO:1310) x AAA59968 . . .

Alignment segment 1/1:

Quality: 3056.00  Escore: 0
Matching length: 311  Total length: 311
Matching Percent Similarity: 100.00  Matching Percent Identity: 100.00
Total Percent Similarity: 100.00  Total Percent Identity: 100.00
Gaps: 0

Sequence name: /tmp/y03EwE6i01/dRQ5l2K6e2: AAH14562 (SEQ ID NO:1703)

Sequence documentation:

Alignment of: HUMODCA_P9 (SEQ ID NO:1310) x AAH14562 (SEQ ID NO:1703) . . .

Alignment segment 1/1:

Quality: 3056.00  Escore: 0
Matching length: 311  Total length: 311
Matching Percent Similarity: 100.00  Matching Percent Identity: 100.00
Total Percent Similarity: 100.00  Total Percent Identity: 100.00
Gaps: 0

Alignment:

```
 30 LVLRIATDDSKAVCRLSVKFGATLRTSRLLLERAKELNIDVVGVSFHVGS  79
    |||||||||||||||||||||||||||||||||||||||||||||||||
 40 LVLRIATDDSKAVCRLSVKFGATLRTSRLLLERAKELNIDVVGVSFHVGS  89

80 GCTDPETFVQAISDARCVFDMGAEVGFSMYLLDIGGGFPGSEDVKLKFEE 129
    |||||||||||||||||||||||||||||||||||||||||||||||||
 90 GCTDPETFVQAISDARCVFDMGAEVGFSMYLLDIGGGFPGSEDVKLKFEE 139

130 ITGVINPALDKYFPSDSGVRIIAEPGRYYVASAFTLAVNIIAKKIVLKEQ 179
    |||||||||||||||||||||||||||||||||||||||||||||||||
140 ITGVINPALDKYFPSDSGVRIIAEPGRYYVASAFTLAVNIIAKKIVLKEQ 189

180 TGSDDEDESSEQTFMYYVNDGVYGSFNCILYDHAHVKPLLQKRPKPDEKY 229
    |||||||||||||||||||||||||||||||||||||||||||||||||
190 TGSDDEDESSEQTFMYYVNDGVYGSFNCILYDHAHVKPLLQKRPKPDEKY 239

230 YSSSIWGPTCDGLDRIVERCDLPEMHVGDWMLFENMGAYTVAAASTFNGF 279
    |||||||||||||||||||||||||||||||||||||||||||||||||
240 YSSSIWGPTCDGLDRIVERCDLPEMHVGDWMLFENMGAYTVAAASTFNGF 289

280 QRPTIYYVMSGPAWQLMQQFQNPDFPPEVEEQDASTLPVSCAWESGMKRH 329
    |||||||||||||||||||||||||||||||||||||||||||||||||
290 YSSSIWGPTCDGLDRIVERCDLPEMHVGDWMLFENMGAYTVAAASTFNGF 339

330 RAACASASINV            340
    |||||||||||
340 RAACASASINV            350
```

Alignment:

```
 30 LVLRIATDDSKAVCRLSVKFGATLRTSRLLLERAKELNIDVVGVSFHVGS  79
    |||||||||||||||||||||||||||||||||||||||||||||||||
 86 LVLRIATDDSKAVCRLSVKFGATLRTSRLLLERAKELNIDVVGVSFHVGS 135

80 GCTDPETFVQAISDARCVFDMGAEVGFSMYLLDIGGGFPGSEDVKLKFEE 129
    |||||||||||||||||||||||||||||||||||||||||||||||||
136 GCTDPETFVQAISDARCVFDMGAEVGFSMYLLDIGGGFPGSEDVKLKFEE 185

130 ITGVINPALDKYFPSDSGVRIIAEPGRYYVASAFTLAVNIIAKKIVLKEQ 179
    |||||||||||||||||||||||||||||||||||||||||||||||||
186 ITGVINPALDKYFPSDSGVRIIAEPGRYYVASAFTLAVNIIAKKIVLKEQ 235
```

-continued

```
180 TGSDDEDESSEQTFMYYVNDGVYGSFNCILYDHAHVKPLLQKRPKPDEKY 229
    ||||||||||||||||||||||||||||||||||||||||||||||||||
236 TGSDDEDESSEQTFMYYVNDGVYGSFNCILYDHAHVKPLLQKRPKPDEKY 285

230 YSSSIWGPTCDGLDRIVERCDLPEMHVGDWMLFENMGAYTVAAASTFNGF 279
    ||||||||||||||||||||||||||||||||||||||||||||||||||
286 YSSSIWGPTCDGLDRIVERCDLPEMHVGDWMLFENMGAYTVAAASTFNGF 335

280 QRPTIYYVMSGPAWQLMQQFQNPDFPPEVEEQDASTLPVSCAWESGMKRH 329
    ||||||||||||||||||||||||||||||||||||||||||||||||||
336 YSSSIWGPTCDGLDRIVERCDLPEMHVGDWMLFENMGAYTVAAASTFNGF 385

330 RAACASASINV                                        340
    |||||||||||
386 RAACASASINV                                        396
```

Description for Cluster R00299

Cluster R00299 features 1 transcript(s) and 12 segment(s) of interest, the names for which are given in Tables 275 and 276, respectively, the sequences themselves are given at the end of the application. The selected protein variants are given in table 277.

TABLE 275

Transcripts of interest

| Transcript Name | Sequence ID No. |
|---|---|
| R00299_T2 | 33 |

TABLE 276

Segments of interest

| Segment Name | Sequence ID No. |
|---|---|
| R00299_node_2 | 422 |
| R00299_node_30 | 423 |
| R00299_node_10 | 424 |
| R00299_node_14 | 425 |
| R00299_node_15 | 426 |
| R00299_node_20 | 427 |
| R00299_node_23 | 428 |
| R00299_node_25 | 429 |
| R00299_node_28 | 430 |
| R00299_node_31 | 431 |
| R00299_node_5 | 432 |
| R00299_node_9 | 433 |

TABLE 277

Proteins of interest

| Protein Name | Sequence ID No. |
|---|---|
| R00299_P3 | 1311 |

These sequences are variants of the known protein Tescalcin (SwissProt accession identifier TESC_HUMAN; known also according to the synonyms TSC), SEQ ID NO: 1427, referred to herein as the previously known protein.

Protein Tescalcin (SEQ ID NO:1427) is known or believed to have the following function(s): Binds calcium. The sequence for protein Tescalcin is given at the end of the application, as "Tescalcin amino acid sequence".

The following GO Annotation(s) apply to the previously known protein. The following annotation(s) were found: calcium binding, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster R00299 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 26 below refer to weighted expression of ESTs in each category, as "parts per million" (ratio of the expression of ESTs for a particular cluster to the expression of all ESTs in that category, according to parts per million).

Figure 26:
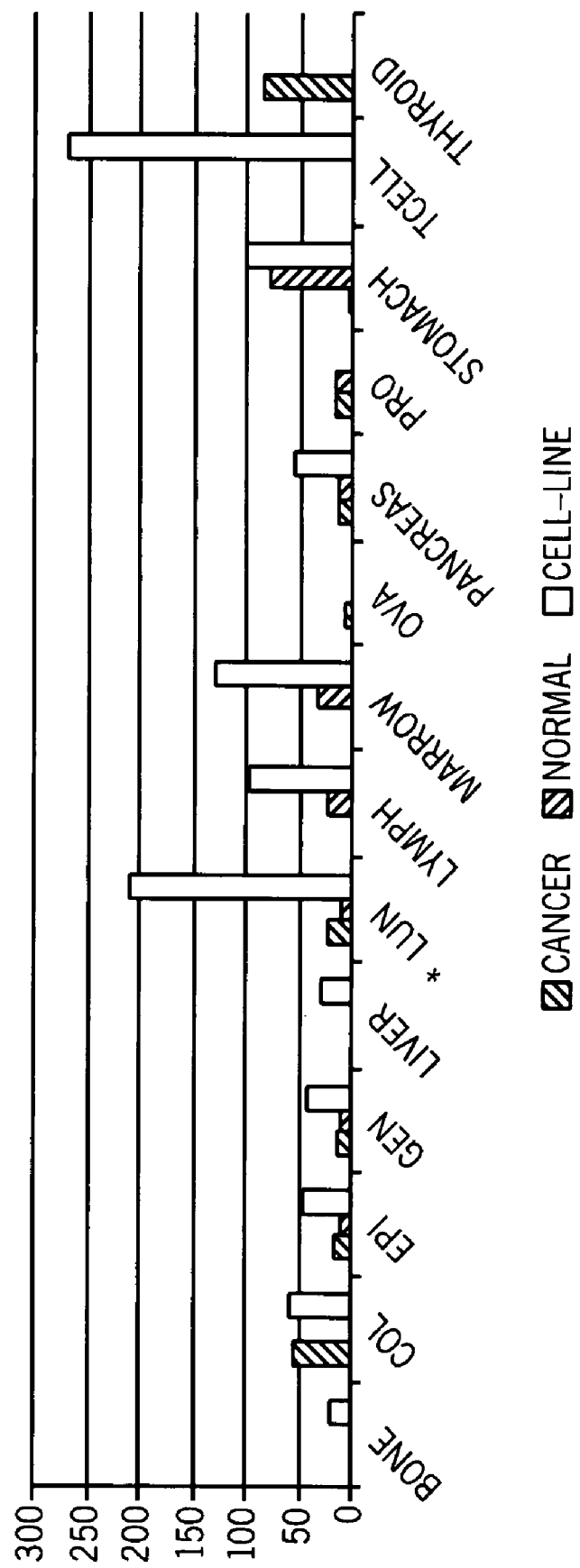
FIG. 26 is a histogram showing Cancer and cell-line vs. normal tissue expression for Cluster R00299, demonstrating overexpression in lung malignant tumors.

Overall, the following results were obtained as shown with regard to the histograms in FIG. 26 and Table 278. This cluster is overexpressed (at least at a minimum level) in the following pathological conditions: lung malignant tumors.

TABLE 278

Normal tissue distribution

| Name of Tissue | Number |
|---|---|
| bone | 0 |
| colon | 0 |
| epithelial | 11 |
| general | 11 |
| liver | 0 |
| lung | 10 |
| lymph nodes | 22 |
| bone marrow | 31 |
| ovary | 0 |
| pancreas | 14 |
| prostate | 16 |
| stomach | 76 |
| T cells | 0 |
| Thyroid | 0 |

TABLE 279

P values and ratios for expression in cancerous tissue

| Name of Tissue | P1 | P2 | SP1 | R3 | SP2 | R4 |
|---|---|---|---|---|---|---|
| bone | 1 | 6.7e−01 | 1 | 1.0 | 7.0e−01 | 1.4 |
| colon | 5.0e−02 | 5.3e−02 | 2.4e−01 | 2.8 | 2.1e−01 | 2.8 |

TABLE 279-continued

P values and ratios for expression in cancerous tissue

| Name of Tissue | P1 | P2 | SP1 | R3 | SP2 | R4 |
|---|---|---|---|---|---|---|
| epithelial | 7.7e−02 | 9.5e−02 | 4.0e−01 | 1.3 | 6.1e−03 | 1.9 |
| general | 2.3e−01 | 2.6e−01 | 5.3e−01 | 1.0 | 2.6e−04 | 1.9 |
| liver | 1 | 4.5e−01 | 1 | 1.0 | 6.9e−01 | 1.5 |
| lung | 4.9e−01 | 2.7e−01 | 6.5e−01 | 1.7 | 5.6e−04 | 3.8 |
| lymph nodes | 8.5e−01 | 8.7e−01 | 1 | 0.5 | 2.0e−01 | 1.1 |
| bone marrow | 8.6e−01 | 8.5e−01 | 1 | 0.5 | 2.3e−01 | 1.4 |
| ovary | 4.0e−01 | 4.4e−01 | 1 | 1.1 | 1 | 1.1 |
| pancreas | 7.2e−01 | 6.9e−01 | 6.7e−01 | 1.0 | 3.5e−01 | 1.5 |
| prostate | 8.7e−01 | 9.1e−01 | 6.7e−01 | 1.0 | 7.5e−01 | 0.9 |
| stomach | 6.6e−01 | 7.5e−01 | 1 | 0.4 | 6.7e−01 | 0.7 |
| T cells | 1 | 6.7e−01 | 1 | 1.0 | 5.2e−01 | 1.8 |
| Thyroid | 1.8e−01 | 1.8e−01 | 6.7e−01 | 1.6 | 6.7e−01 | 1.6 |

As noted above, cluster R00299 features 1 transcript(s), which were listed in Table 275 above. These transcript(s) encode for protein(s) which are variant(s) of protein Tescalcin (SEQ ID NO:1427). A description of each variant protein according to the present invention is now provided.

Variant protein R00299_P3 (SEQ ID NO: 1311) according to the present invention has an amino acid sequence as given at the end of the application; it is encoded by transcript(s) R00299_T2 (SEQ ID NO:33). An alignment is given to the known protein (Tescalcin (SEQ ID NO:1427)) at the end of the application. One or more alignments to one or more previously published protein sequences are given at the end of the application. A brief description of the relationship of the variant protein according to the present invention to each such aligned protein is as follows:

Comparison report between R00299_P3 (SEQ ID NO:1311) and Q9NWT9 (SEQ ID NO:1704):

1. An isolated chimeric polypeptide encoding for R00299_P3 (SEQ ID NO: 1311), comprising a first amino acid sequence being at least 70%, optionally at least 80%, preferably at least 85%, more preferably at least 90% and most preferably at least 95% homologous to a polypeptide having the sequence MAEKALLCPSSAGLGTWPWVLN-SAWPVLPLAVDQGVDWRPRGPV (SEQ ID NO:1769) corresponding to amino acids 1-44 of R00299_P3 (SEQ ID NO:1311), second amino acid sequence being at least 90% homologous to SSDQIEQLHRRFKQLSGDQPTIRKEN-FNNVPDLELNPIRSKIVRAFFDNRNL-RKGPSGLADEINFEDFLTIMS YFRPIDTTMDEEQV-ELSRKEKLRFLFHMYDSDSDGRITLEEYRNV corresponding to amino acids 74-191 of Q9NWT9 (SEQ ID NO:1704), which also corresponds to amino acids 45-162 of R00299_P3 (SEQ ID NO:1311), and a third amino acid sequence being at least 70%, optionally at least 80%, preferably at least 85%, more preferably at least 90% and most preferably at least 95% homologous to a polypeptide having the sequence VEELLSGNPHIEKESARSIADGAM-MEAASVCMGQMEPDQVYEGITFEDFLKI-WQGIDIETKMHVRFLNME TMALCH (SEQ ID NO: 1770) corresponding to amino acids 163-238 of R00299_P3 (SEQ ID NO:1311), wherein said first, second and third amino acid sequences are contiguous and in a sequential order.

2. An isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPVL-PLAVDQGVDWRPRGPV (SEQ ID NO:1769) of R00299_P3 (SEQ ID NO:1311).

3. An isolated polypeptide encoding for a tail of R00299_P3 (SEQ ID NO: 1311), comprising a polypeptide being at least 70%, optionally at least about 80%, preferably at least about 85%, more preferably at least about 90% and most preferably at least about 95% homologous to the sequence VEELLSGNPHIEKESARSIADGAM-MEAASVCMGQMEPDQVYEGITFEDFLKI-WQGIDIETKMHVRFLNME TMALCH (SEQ ID NO:1770) in R00299_P3 (SEQ ID NO:1311).

Comparison report between R00299_P3 (SEQ ID NO:1311) and TESC_HUMAN (SEQ ID NO:1427):

1. An isolated chimeric polypeptide encoding for R00299_P3 (SEQ ID NO:1311), comprising a first amino acid sequence being at least 70%, optionally at least 80%, preferably at least 85%, more preferably at least 90% and most preferably at least 95% homologous to a polypeptide having the sequence MAEKALLCPSSAGLGTWPWVLN-SAWPVLPLAVDQGVDWRPRGPV (SEQ ID NO: 1769) corresponding to amino acids 1-44 of R00299_P3 (SEQ ID NO:1311), and a second amino acid sequence being at least 90% homologous to SSDQIEQLHRRFKQLSGDQP-TIRKENFNNVPDLELNPIRSKIVRAFFD-NRNLRKGPSGLADEINFEDFLTIMS YFRPIDTTMDE-EQVELSRKEKLRFLFHMYDSDSDGRITLEEYRNVVE-ELLSGNPHIEKESARSIADGAMME AASVCMGQMEP-DQVYEGITFEDFLKIWQGIDIETKMHVR-FLNMETMALCH (SEQ ID NO: 1770) corresponding to amino acids 21-214 of TESC_HUMAN (SEQ ID NO:1427), which also corresponds to amino acids 45-238 of R00299_P3 (SEQ ID NO:1311), wherein said first and second amino acid sequences are contiguous and in a sequential order.

2. An isolated polypeptide encoding for a head of R00299_P3 (SEQ ID NO:1311), comprising a polypeptide being at least 70%, optionally at least about 80%, preferably at least about 85%, more preferably at least about 90% and most preferably at least about 95% homologous to the sequence MAEKALLCPSSAGLGTWPWVLNSAWPVL-PLAVDQGVDWRPRGPV (SEQ ID NO: 1769) of R00299_P3 (SEQ ID NO:1311).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein R00299P3 (SEQ ID NO:1311) also has the following non-silent SNPs (Single Nucleotide Polymorphisms) as listed in Table 280, (given according to their position(s) on the amino acid sequence, with the alternative amino acid(s) listed; the last column indicates whether the SNP is known or not; the presence of known SNPs in variant protein R00299_P3 (SEQ ID NO:1311) sequence provides support for the deduced sequence of this variant protein according to the present invention).

TABLE 280

Amino acid mutations

| SNP position(s) on amino acid sequence | Alternative amino acid(s) | Previously known SNP? |
|---|---|---|
| 120 | R -> G | No |
| 120 | R -> W | No |

Variant protein R00299_P3 (SEQ ID NO:1311) is encoded by the following transcript(s): R00299_T2 (SEQ ID NO:33), for which the sequence(s) is/are given at the end of the application. The coding portion of transcript R00299_T2 (SEQ ID NO:33) is shown in bold; this coding portion starts at position 142 and ends at position 855. The transcript also has the following SNPs as listed in Table 281 (given according to their position on the nucleotide sequence, with the alternative nucleic acid listed; the last column indicates whether the SNP is known or not; the presence of known SNPs in variant protein R00299_P3 (SEQ ID NO:1311) sequence provides support for the deduced sequence of this variant protein according to the present invention).

TABLE 281

Nucleic acid SNPs

| SNP position on nucleotide sequence | Alternative nucleic acid | Previously known SNP? |
|---|---|---|
| 177 | C -> A | Yes |
| 499 | C -> G | No |
| 499 | C -> T | No |
| 900 | G -> T | Yes |
| 916 | G -> | No |
| 969 | G -> | No |
| 969 | G -> A | No |
| 987 | A -> C | No |

As noted above, cluster R00299 features 12 segment(s), which were listed in Table 276 above and for which the sequence(s) are given at the end of the application. These segment(s) are portions of nucleic acid sequence(s) which are described herein separately because they are of particular interest. A description of each segment according to the present invention is now provided.

Segment cluster R00299_node_2 (SEQ ID NO:1216) according to the present invention is supported by 3 libraries. The number of libraries was determined as previously described. This segment can be found in the following transcript(s): R00299_T2 (SEQ ID NO:33). Table 282 below describes the starting and ending position of this segment on each transcript.

TABLE 282

Segment location on transcripts

| Transcript name | Segment starting position | Segment ending position |
|---|---|---|
| R00299_T2 (SEQ ID NO:33) | 1 | 271 |

Segment cluster R00299_node_30 (SEQ ID NO:1217) according to the present invention is supported by 75 libraries. The number of libraries was determined as previously described. This segment can be found in the following transcript(s): R00299_T2 (SEQ ID NO:33). Table 283 below describes the starting and ending position of this segment on each transcript.

TABLE 283

Segment location on transcripts

| Transcript name | Segment starting position | Segment ending position |
|---|---|---|
| R00299_T2 (SEQ ID NO:33) | 790 | 961 |

According to an optional embodiment of the present invention, short segments related to the above cluster are also provided. These segments are up to about 120 bp in length, and so are included in a separate description.

Segment cluster R00299_node_10 (SEQ ID NO:1218) according to the present invention is supported by 46 libraries. The number of libraries was determined as previously described. This segment can be found in the following transcript(s): R00299_T2 (SEQ ID NO:33). Table 284 below describes the starting and ending position of this segment on each transcript.

TABLE 284

Segment location on transcripts

| Transcript name | Segment starting position | Segment ending position |
|---|---|---|
| R00299_T2 (SEQ ID NO:33) | 346 | 422 |

Segment cluster R00299_node_14 (SEQ ID NO:1219) according to the present invention is supported by 61 libraries. The number of libraries was determined as previously described. This segment can be found in the following transcript(s): R00299_T2 (SEQ ID NO:33). Table 285 below describes the starting and ending position of this segment on each transcript.

TABLE 285

Segment location on transcripts

| Transcript name | Segment starting position | Segment ending position |
|---|---|---|
| R00299_T2 (SEQ ID NO:33) | 423 | 537 |

Segment cluster R00299_node_15 (SEQ ID NO:1220) according to the present invention can be found in the following transcript(s): R00299_T2 (SEQ ID NO:33). Table 286 below describes the starting and ending position of this segment on each transcript.

TABLE 286

Segment location on transcripts

| Transcript name | Segment starting position | Segment ending position |
|---|---|---|
| R00299_T2 (SEQ ID NO:33) | 538 | 562 |

Segment cluster R00299_node_20 (SEQ ID NO:1221) according to the present invention is supported by 66 libraries. The number of libraries was determined as previously described. This segment can be found in the following transcript(s): R00299_T2 (SEQ ID NO:33). Table 287 below describes the starting and ending position of this segment on each transcript.

TABLE 287

Segment location on transcripts

| Transcript name | Segment starting position | Segment ending position |
|---|---|---|
| R00299_T2 (SEQ ID NO:33) | 563 | 624 |

Segment cluster R00299_node_23 (SEQ ID NO:1222) according to the present invention is supported by 71 libraries. The number of libraries was determined as previously described. This segment can be found in the following transcript(s): R00299_T2 (SEQ ID NO:33). Table 288 below describes the starting and ending position of this segment on each transcript.

TABLE 288

Segment location on transcripts

| Transcript name | Segment starting position | Segment ending position |
|---|---|---|
| R00299_T2 (SEQ ID NO:33) | 625 | 732 |

Segment cluster R00299_node_25 (SEQ ID NO:1223) according to the present invention is supported by 62 libraries. The number of libraries was determined as previously described. This segment can be found in the following transcript(s): R00299_T2 (SEQ ID NO:33). Table 289 below describes the starting and ending position of this segment on each transcript.

TABLE 289

Segment location on transcripts

| Transcript name | Segment starting position | Segment ending position |
|---|---|---|
| R00299_T2 (SEQ ID NO:33) | 733 | 780 |

Segment cluster R00299_node_28 (SEQ ID NO:1224) according to the present invention can be found in the following transcript(s): R00299_T2 (SEQ ID NO:33). Table 290 below describes the starting and ending position of this segment on each transcript.

TABLE 290

Segment location on transcripts

| Transcript name | Segment starting position | Segment ending position |
|---|---|---|
| R00299_T2 (SEQ ID NO:33) | 781 | 789 |

Segment cluster R00299_node_31 (SEQ ID NO:1225) according to the present invention is supported by 48 libraries. The number of libraries was determined as previously described. This segment can be found in the following transcript(s): R00299_T2 (SEQ ID NO:33). Table 291 below describes the starting and ending position of this segment on each transcript.

TABLE 291

Segment location on transcripts

| Transcript name | Segment starting position | Segment ending position |
|---|---|---|
| R00299_T2 (SEQ ID NO:33) | 962 | 1069 |

Segment cluster R00299_node_5 (SEQ ID NO:1226) according to the present invention is supported by 45 libraries. The number of libraries was determined as previously described. This segment can be found in the following transcript(s): R00299_T2 (SEQ ID NO:33). Table 292 below describes the starting and ending position of this segment on each transcript.

TABLE 292

Segment location on transcripts

| Transcript name | Segment starting position | Segment ending position |
|---|---|---|
| R00299_T2 (SEQ ID NO:33) | 272 | 341 |

Segment cluster R00299_node_9 (SEQ ID NO:1227) according to the present invention can be found in the following transcript(s): R00299_T2 (SEQ ID NO:33). Table 293 below describes the starting and ending position of this segment on each transcript.

TABLE 293

Segment location on transcripts

| Transcript name | Segment starting position | Segment ending position |
|---|---|---|
| R00299_T2 (SEQ ID NO:33) | 342 | 345 |

Microarray (chip) data is also available for this gene as follows. As described above with regard to the cluster itself, various oligonucleotides were tested for being differentially expressed in various disease conditions, particularly cancer. The following oligonucleotide was found to hit this segment (with regard to lung cancer), shown in Table 294.

TABLE 294

Oligonucleotide related to this gene

| Oligonucleotide name | Overexpressed in cancers | Chip reference |
|---|---|---|
| R00299_0_8_0 (SEQ ID NO: 217) | lung cancer | Lung |

Variant protein alignment to the previously known protein:

Sequence name: /tmp/OleVDhrKQ0/EjblgLomjM: Q9NWT9 (SEQ ID NO:1704)

Sequence documentation:

Alignment of: R00299_P3 (SEQ ID NO:1311) x Q9NWT9 (SEQ ID NO:1704) . . .

Alignment segment 1/1:

| | | | |
|---|---|---|---|
| Quality: | 1162.00 | Escore: | 0 |
| Matching length: | 118 | Total length: | 118 |
| Matching Percent Identity: | 100.00 | Matching Percent Identity: | 100.00 |
| Total Percent Similarity: | 100.00 | Total Percent Identity: | 100.00 |
| Gaps: | 0 | | |

Alignment:

```
 45 SSDQIEQLHRRFKQLSGDQPTIRKENFNNVPDLELNPIRSKIVRAFFDNR  94
    |||||||||||||||||||||||||||||||||||||||||||||||||
 74 SSDQIEQLHRRFKQLSGDQPTIRKENFNNVPDLELNPIRSKIVRAFFDNR 123

95 NLRKGPSGLADEINFEDFLTIMSYFRPIDTTMDEEQVELSRKEKLRFLFH 144
    |||||||||||||||||||||||||||||||||||||||||||||||||
124 NLRKGPSGLADEINFEDFLTIMSYFRPIDTTMDEEQVELSRKEKLRFLFH 173

145 MYDSDSDGRITLEEYRNV                                 162
    ||||||||||||||||||
174 MYDSDSDGRITLEEYRNV                                 191
```

Sequence name: /tmp/OleVDhrKQ0/EjblgLomjM:TESC_HUMAN (SEQ ID NO:1427)

Sequence documentation:

Alignment of: R00299_P3 (SEQ ID NO:1311) x TESC_HUMAN (SEQ ID NO:1427) . . .

Alignment segment 1/1:

| | | | |
|---|---|---|---|
| Quality: | 1920.00 | Escore: | 0 |
| Matching length: | 194 | Total length: | 194 |
| Matching Percent Identity: | 100.00 | Matching Percent Identity: | 100.00 |
| Total Percent Similarity: | 100.00 | Total Percent Identity: | 100.00 |
| Gaps: | 0 | | |

Alignment:

```
 45 SSDQIEQLHRRFKQLSGDQPTIRKENFNNVPDLELNPIRSKIVRAFFDNR  94
    |||||||||||||||||||||||||||||||||||||||||||||||||
 21 SSDQIEQLHRRFKQLSGDQPTIRKENFNNVPDLELNPIRSKIVRAFFDNR  70

95 NLRKGPSGLADEINFEDFLTIMSYFRPIDTTMDEEQVELSRKEKLRFLFH 144
    |||||||||||||||||||||||||||||||||||||||||||||||||
 71 NLRKGPSGLADEINFEDFLTIMSYFRPIDTTMDEEQVELSRKEKLRFLFH 120

145 MYDSDSDGRITLEEYRNVVEELLSGNPHIEKESARSIADGAMMEAASVCM 194
    |||||||||||||||||||||||||||||||||||||||||||||||||
121 MYDSDSDGRITLEEYRNVVEELLSGNPHIEKESARSIADGAMMEAASVCM 170

195 GQMEPDQVYEGITFEDFLKIWQGIDIETKMHVRFLNMETMALCH       238
    |||||||||||||||||||||||||||||||||||||||||||
171 GQMEPDQVYEGITFEDFLKIWQGIDIETKMHVRFLNMETMALCH       214
```

Description for Cluster W60282

Cluster W60282 features 1 transcript(s) and 6 segment(s) of interest, the names for which are given in Tables 295 and 296, respectively, the sequences themselves are given at the end of the application. The selected protein variants are given in table 297.

TABLE 295

Transcripts of interest

| Transcript name | Sequence ID No. |
|---|---|
| W60282_PEA_1_T11 | 34 |

TABLE 296

Segments of interest

| Segment Name | Sequence ID No. |
|---|---|
| W60282_PEA_1_node_10 | 434 |
| W60282_PEA_1_node_18 | 435 |
| W60282_PEA_1_node_22 | 436 |
| W60282_PEA_1_node_5 | 437 |
| W60282_PEA_1_node_21 | 438 |
| W60282_PEA_1_node_8 | 439 |

TABLE 297

Proteins of interest

| Protein Name | Sequence ID No. |
|---|---|
| W60282_PEA_1_P14 | 1312 |

These sequences are variants of the known protein Kallikrein 11 precursor (SwissProt accession identifier KLKB_HUMAN; known also according to the synonyms EC 3.4.21.-; Hippostasin; Trypsin-like protease), SEQ ID NO:1428, referred to herein as the previously known protein.

Protein Kallikrein 11 precursor (SEQ ID NO:1428) is known or believed to have the following function(s): Possible multifunctional protease. Efficiently cleaves bz-Phe-Arg-4-methylcoumaryl-7-amide, a kallikrein substrate, and weakly cleaves other substrates for kallikrein and trypsin. The sequence for protein Kallikrein 11 precursor is given at the end of the application, as "Kallikrein 11 precursor amino acid sequence". Protein Kallikrein 11 precursor localization is believed to be Secreted.

The following GO Annotation(s) apply to the previously known protein. The following annotation(s) were found: proteolysis and peptidolysis, which are annotation(s) related to Biological Process; and chymotrypsin; trypsin; serine-type peptidase; hydrolase, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nln dot nih dot gov/projects/LocusLink/>.

As noted above, cluster W60282 features 1 transcript(s), which were listed in Table 295 above. These transcript(s) encode for protein(s) which are variant(s) of protein Kallikrein 11 precursor (SEQ ID NO:1428). A description of each variant protein according to the present invention is now provided.

Variant protein W60282_PEA_1_P14 (SEQ ID NO:1312) according to the present invention has an amino acid sequence as given at the end of the application; it is encoded by transcript(s) W60282_PEA_1_T11 (SEQ ID NO:34). An alignment is given to the known protein (Kallikrein 11 precursor (SEQ ID NO:1428)) at the end of the application. One or more alignments to one or more previously published protein sequences are given at the end of the application. A brief description of the relationship of the variant protein according to the present invention to each such aligned protein is as follows:

Comparison report between W60282_PEA_1_P14 (SEQ ID NO:1312) and Q8IXD7 (SEQ ID NO:1705):

1. An isolated chimeric polypeptide encoding for W60282_PEA_1_P14 (SEQ ID NO:1312), comprising a first amino acid sequence being at least 90% homologous to MRILQLILLALATGLVGGETRIIKG-FECKPHSQPWQAALFEKTR-LLCGATLIAPRWLLTAAHCLKP corresponding to amino acids 1-66 of Q8IXD7 (SEQ ID NO:1705), which also corresponds to amino acids 1-66 of W60282_PEA_1_P14 (SEQ ID NO:1312), and a second amino acid sequence being at least 70%, optionally at least 80%, preferably at least 85%, more preferably at least 90% and most preferably at least 95% homologous to a polypeptide having the sequence TPASHLAMRQHHHH (SEQ ID NO: 1771) corresponding to amino acids 67-80 of W60282_PEA_1_P14 (SEQ ID NO:1312), wherein said first and second amino acid sequences are contiguous and in a sequential order.

2. An isolated polypeptide encoding for a tail of W60282_PEA_1_P14 (SEQ ID NO:1312), comprising a polypeptide being at least 70%, optionally at least about 80%, preferably at least about 85%, more preferably at least about 90% and most preferably at least about 95% homologous to the sequence TPASHLAMRQHHHH (SEQ ID NO: 1771) in W60282_PEA_1_P14 (SEQ ID NO:1312).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein W60282_PEA_1_P14 (SEQ ID NO:1312) also has the following non-silent SNPs (Single Nucleotide Polymorphisms) as listed in Table 298, (given according to their position(s) on the amino acid sequence, with the alternative amino acid(s) listed; the last column indicates whether the SNP is known or not; the presence of known SNPs in variant protein W60282_PEA_1_P14 (SEQ ID NO:1312) sequence provides support for the deduced sequence of this variant protein according to the present invention).

TABLE 298

Amino acid mutations

| SNP position(s) on amino acid sequence | Alternative amino acid(s) | Previously known SNP? |
|---|---|---|
| 17 | G -> E | Yes |
| 41 | E -> K | No |

Variant protein W60282_PEA_1_P14 (SEQ ID NO:1312) is encoded by the following transcript(s): W60282_PEA_1_T11 (SEQ ID NO:34), for which the sequence(s) is/are given at the end of the application. The coding portion of transcript W60282_PEA_1_T11 (SEQ ID NO:34) is shown in bold; this coding portion starts at position 705 and ends at position 944. The transcript also has the following SNPs as listed in Table 299 (given according to their position on the nucleotide sequence, with the alternative nucleic acid listed; the last column indicates whether the SNP is known or not; the presence of known SNPs in variant protein W60282_PEA_1_P14 (SEQ ID NO:1312) sequence provides support for the deduced sequence of this variant protein according to the present invention).

TABLE 299

Nucleic acid SNPs

| SNP position on nucleotide sequence | Alternative nucleic acid | Previously known SNP? |
|---|---|---|
| 219 | A -> G | Yes |
| 702 | G -> A | Yes |
| 754 | G -> A | Yes |
| 825 | G -> A | No |
| 1289 | A -> G | Yes |

As noted above, cluster W60282 features 6 segment(s), which were listed in Table 296 above and for which the sequence(s) are given at the end of the application. These segment(s) are portions of nucleic acid sequence(s) which are described herein separately because they are of particular interest. A description of each segment according to the present invention is now provided.

Segment cluster W60282_PEA_1_node_10 (SEQ ID NO:1228) according to the present invention is supported by 45 libraries. The number of libraries was determined as previously described. This segment can be found in the following transcript(s): W60282_PEA_1_T11 (SEQ ID NO:34). Table 300 below describes the starting and ending position of this segment on each transcript.

TABLE 300

Segment location on transcripts

| Transcript name | Segment starting position | Segment ending position |
|---|---|---|
| W60282_PEA_1_T11 (SEQ ID NO:34) | 745 | 901 |

Segment cluster W60282_PEA_1_node_18 (SEQ ID NO:1229) according to the present invention is supported by 49 libraries. The number of libraries was determined as previously described. This segment can be found in the following transcript(s): W60282_PEA_1_T11 (SEQ ID NO:34). Table 301 below describes the starting and ending position of this segment on each transcript.

TABLE 301

Segment location on transcripts

| Transcript name | Segment starting position | Segment ending position |
|---|---|---|
| W60282_PEA_1_T11 (SEQ ID NO:34) | 902 | 1038 |

Segment cluster W60282_PEA_1_node_22 (SEQ ID NO:1230) according to the present invention is supported by 67 libraries. The number of libraries was determined as previously described. This segment can be found in the following transcript(s): W60282_PEA_1_T11 (SEQ ID NO:34). Table 302 below describes the starting and ending position of this segment on each transcript.

TABLE 302

Segment location on transcripts

| Transcript name | Segment starting position | Segment ending position |
|---|---|---|
| W60282_PEA_1_T11 (SEQ ID NO:34) | 1072 | 1507 |

Segment cluster W60282_PEA_1_node_5 (SEQ ID NO:1231) according to the present invention is supported by 20 libraries. The number of libraries was determined as previously described. This segment can be found in the following transcript(s): W60282_PEA_1_T11 (SEQ ID NO:34). Table 303 below describes the starting and ending position of this segment on each transcript.

TABLE 303

Segment location on transcripts

| Transcript name | Segment starting position | Segment ending position |
|---|---|---|
| W60282_PEA_1_T11 (SEQ ID NO:34) | 1 | 669 |

According to an optional embodiment of the present invention, short segments related to the above cluster are also provided. These segments are up to about 120 bp in length, and so are included in a separate description.

Segment cluster W60282_PEA_1_node_21 (SEQ ID NO:1232) according to the present invention is supported by 48 libraries. The number of libraries was determined as previously described. This segment can be found in the following transcript(s): W60282_PEA_1_T11 (SEQ ID NO:34). Table 304 below describes the starting and ending position of this segment on each transcript.

TABLE 304

Segment location on transcripts

| Transcript name | Segment starting position | Segment ending position |
|---|---|---|
| W60282_PEA_1_T11 (SEQ ID NO:34) | 1039 | 1071 |

Segment cluster W60282_PEA_1_node_8 (SEQ ID NO:1233) according to the present invention is supported by 39 libraries. The number of libraries was determined as previously described. This segment can be found in the following transcript(s): W60282_PEA_1_T11 (SEQ ID NO:34). Table 305 below describes the starting and ending position of this segment on each transcript.

TABLE 305

Segment location on transcripts

| Transcript name | Segment starting position | Segment ending position |
|---|---|---|
| W60282_PEA_1_T11 (SEQ ID NO:34) | 670 | 744 |

Variant protein alignment to the previously known protein:

Sequence name: /tmp/rL7Wdc5hYg/eLOAfKIgqD:KLKB_HUMAN (SEQ ID NO:1428)

Sequence documentation:

Alignment of: W60282_PEA_1_P14 (SEQ ID NO:1312) x KLKB_HUMAN (SEQ ID NO:1428) . . .

Alignment segment 1/1:

| | | | |
|---|---|---|---|
| Quality: | 645.00 | Escore: | 0 |
| Matching length: | 72 | Total length: | 72 |
| Matching Percent Similarity: | 94.44 | Matching Percent Identity: | 94.44 |
| Total Percent Similarity: | 94.44 | Total Percent Identity: | 94.44 |
| Gaps: | 0 | | |

Alignment:

```
1  MRILQLILLALATGLVGGETRIIGFECKPHSQPWQAALFEKTRLLCGAT  50
   ||||||||||||||||||||||||||||||||||||||||||||||||
1  MRILQLILLALATGLVGGETRIIGFECKPHSQPWQAALFEKTRLLCGAT  50

51 LIAPRWLLTAAHCLKPTPASHL                              72
   |||||||||||||||||   ||
51 LIAPRWLLTAAHCLKPRYIVHL                              72
```

Sequence name: /tmp/rL7Wdc5hYg/eLOAfKIgqD:Q8IXD7 (SEQ ID NO:1705)

Sequence documentation:

Alignment of: W60282_PEA_1_P14 (SEQ ID NO:1312) x Q8IXD7 (SEQ ID NO:1705)

Alignment segment 1/1:

| | | | |
|---|---|---|---|
| Quality: | 642.00 | Escore: | 0 |
| Matching length: | 66 | Total length: | 66 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MRILQLILLALATGLVGGETRIIGFECKPHSQPWQAALFEKTRLLCGAT  50
   ||||||||||||||||||||||||||||||||||||||||||||||||
1  MRILQLILLALATGLVGGETRIIGFECKPHSQPWQAALFEKTRLLCGAT  50

51 LIAPRWLLTAAHCLKP                                    66
   ||||||||||||||||
51 LIAPRWLLTAAHCLKP                                    66
```

Description for Cluster Z41644

Cluster Z41644 features 1 transcript(s) and 21 segment(s) of interest, the names for which are given in Tables 306 and 307, respectively, the sequences themselves are given at the end of the application. The selected protein variants are given in table 308.

TABLE 306

Transcripts of interest

| Transcript name | Sequence ID No. |
|---|---|
| Z41644_PEA_1_T5 | 35 |

TABLE 307

Segments of interest

| Segment Name | Sequence ID No. |
|---|---|
| Z41644_PEA_1_node_0 | 440 |
| Z41644_PEA_1_node_11 | 441 |
| Z41644_PEA_1_node_12 | 442 |
| Z41644_PEA_1_node_15 | 443 |
| Z41644_PEA_1_node_20 | 444 |
| Z41644_PEA_1_node_24 | 445 |
| Z41644_PEA_1_node_1 | 446 |
| Z41644_PEA_1_node_10 | 447 |
| Z41644_PEA_1_node_13 | 448 |
| Z41644_PEA_1_node_16 | 449 |
| Z41644_PEA_1_node_17 | 450 |
| Z41644_PEA_1_node_19 | 451 |
| Z41644_PEA_1_node_2 | 452 |
| Z41644_PEA_1_node_21 | 453 |
| Z41644_PEA_1_node_22 | 454 |
| Z41644_PEA_1_node_23 | 455 |
| Z41644_PEA_1_node_25 | 456 |
| Z41644_PEA_1_node_3 | 457 |
| Z41644_PEA_1_node_4 | 458 |
| Z41644_PEA_1_node_6 | 459 |
| Z41644_PEA_1_node_9 | 460 |

TABLE 308

Proteins of interest

| Protein Name | Sequence ID No. |
|---|---|
| Z41644_PEA_1_P10 | 1313 |

These sequences are variants of the known protein Small inducible cytokine B14 precursor (SwissProt accession identifier SZ14_HUMAN; known also according to the synonyms CXCL14; Chemokine BRAK), SEQ ID NO:1429, referred to herein as the previously known protein.

The sequence for protein Small inducible cytokine B14 precursor (SEQ ID NO:1429) is given at the end of the application, as "Small inducible cytokine B14 precursor amino acid sequence". Protein Small inducible cytokine B14 precursor localization is believed to be Secreted.

The following GO Annotation(s) apply to the previously known protein. The following annotation(s) were found: chemotaxis; signal transduction; cell-cell signaling, which are annotation(s) related to Biological Process; and chemokine, which are annotation(s) related to Molecular Function.

The GO assignment relies on information from one or more of the SwissProt/TreBl Protein knowledgebase, available from <dot expasy dot ch/sprot/>; or Locuslink, available from <dot ncbi dot nlm dot nih dot gov/projects/LocusLink/>.

Cluster Z41644 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 27 refer to weighted expression of ESTs in each category, as "parts per million" (ratio of the expression of ESTs for a particular cluster to the expression of all ESTs in that category, according to parts per million).

Figure 27:
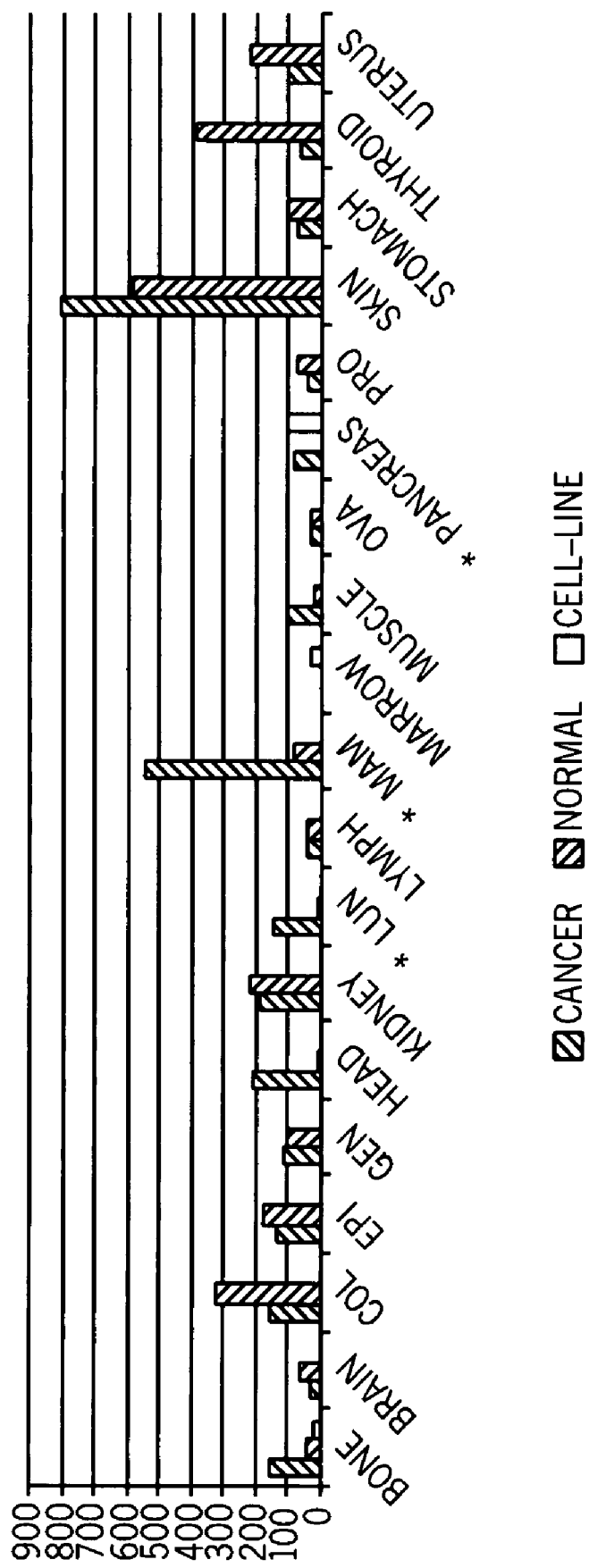
FIG. 27 is a histogram showing Cancer and cell-line vs. normal tissue expression for Cluster Z41644, demonstrating overexpression in lung malignant tumors, breast malignant tumors and pancreas carcinoma.

Overall, the following results were obtained as shown with regard to the histograms in FIG. 27 and Table 309. This cluster is overexpressed (at least at a minimum level) in the following pathological conditions: lung malignant tumors, breast malignant tumors and pancreas carcinoma.

TABLE 309

Normal tissue distribution

| Name of Tissue | Number |
| --- | --- |
| bone | 45 |
| brain | 62 |
| colon | 327 |
| epithelial | 179 |
| general | 104 |
| head and neck | 10 |
| kidney | 219 |
| lung | 6 |
| lymph nodes | 37 |
| breast | 87 |
| bone marrow | 0 |
| muscle | 20 |
| ovary | 36 |
| pancreas | 0 |
| prostate | 78 |
| skin | 591 |
| stomach | 109 |
| Thyroid | 386 |
| uterus | 218 |

TABLE 310

P values and ratios for expression in cancerous tissue

| Name of Tissue | P1 | P2 | SP1 | R3 | SP2 | R4 |
| --- | --- | --- | --- | --- | --- | --- |
| bone | 4.9e−01 | 8.5e−01 | 1.8e−01 | 1.9 | 5.3e−01 | 1.0 |
| brain | 6.7e−01 | 8.0e−01 | 9.1e−01 | 0.6 | 9.9e−01 | 0.4 |
| colon | 6.4e−01 | 7.7e−01 | 9.7e−01 | 0.4 | 1 | 0.3 |
| epithelial | 4.1e−01 | 9.4e−01 | 9.6e−01 | 0.7 | 1 | 0.4 |
| general | 1.5e−01 | 9.4e−01 | 1.8e−01 | 1.0 | 1 | 0.5 |
| head and neck | 1.9e−01 | 3.3e−01 | 4.6e−01 | 2.8 | 7.5e−01 | 1.5 |
| kidney | 7.7e−01 | 8.2e−01 | 7.0e−01 | 0.7 | 9.5e−01 | 0.5 |
| lung | 2.2e−01 | 5.0e−01 | 1.3e−04 | 8.7 | 8.1e−03 | 4.1 |
| lymph nodes | 6.3e−01 | 8.7e−01 | 6.3e−01 | 1.2 | 9.2e−01 | 0.6 |
| breast | 4.0e−01 | 6.5e−01 | 3.9e−04 | 3.5 | 2.9e−02 | 1.9 |
| bone marrow | 1 | 6.7e−01 | 1 | 1.0 | 5.3e−01 | 1.9 |
| muscle | 5.2e−01 | 6.1e−01 | 2.7e−01 | 3.2 | 6.3e−01 | 1.2 |
| ovary | 6.7e−01 | 7.1e−01 | 7.6e−01 | 1.0 | 8.6e−01 | 0.8 |
| pancreas | 2.2e−02 | 2.3e−02 | 5.7e−03 | 7.8 | 1.6e−03 | 8.2 |
| prostate | 8.8e−01 | 9.0e−01 | 8.3e−01 | 0.6 | 9.3e−01 | 0.5 |
| skin | 5.9e−01 | 6.9e−01 | 2.3e−01 | 0.3 | 1 | 0.0 |
| stomach | 6.1e−01 | 8.9e−01 | 8.1e−01 | 0.7 | 9.9e−01 | 0.4 |
| Thyroid | 7.0e−01 | 7.0e−01 | 9.9e−01 | 0.4 | 9.9e−01 | 0.4 |
| uterus | 5.3e−01 | 8.2e−01 | 9.5e−01 | 0.5 | 1 | 0.3 |

As noted above, cluster Z41644 features 1 transcript(s), which were listed in Table 306 above. These transcript(s) encode for protein(s) which are variant(s) of protein Small inducible cytokine B14 precursor (SEQ ID NO:1429). A description of each variant protein according to the present invention is now provided.

Variant protein Z41644_PEA_1_P10 (SEQ ID NO:1313) according to the present invention has an amino acid sequence as given at the end of the application; it is encoded by transcript(s) Z41644_PEA_1_T5 (SEQ ID NO:35). An alignment is given to the known protein (Small inducible cytokine B14 precursor (SEQ ID NO:1429)) at the end of the application. One or more alignments to one or more previously published protein sequences are given at the end of the application. A brief description of the relationship of the variant protein according to the present invention to each such aligned protein is as follows:

Comparison report between Z41644_PEA_1_P10 (SEQ ID NO:1313) and SZ14_HUMAN (SEQ ID NO:1429):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKM-VIITTKSVSRYRGQE HCLHPKLQSTKRFIKW-YNAWNEKRR corresponding to amino acids 1-95 of SZ14_HUMAN (SEQ ID NO:1429), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO: 1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1772) in Z41644_PEA_1_P10 (SEQ ID NO:1313).

Comparison report between Z41644_PEA_1_P10 (SEQ ID NO:1313) and Q9NS21 (SEQ ID NO:1706):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKM-VIITTKSVSRYRGQE HCLHPKLQSTKRFIKW- YNAWNEKRR corresponding to amino acids 13-107 of Q9NS21 (SEQ ID NO:1706), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO: 1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1772) in Z41644_PEA_1_P10 (SEQ ID NO:1313).

Comparison report between Z41644_PEA_1_P10 (SEQ ID NO:1313) and AAQ89265 (SEQ ID NO:781):

1. An isolated chimeric polypeptide encoding for Z41644_PEA_1_P10 (SEQ ID NO:1313), comprising a first amino acid sequence being at least 90% homologous to MRLLAAALLLLLLALYTARVDGSKCKCS-RKGPKIRYSDVKKLEMKPKYPHCEEKM-VIITTKSVSRYRGQE HCLHPKLQSTKRFIKW-YNAWNEKRR corresponding to amino acids 13-107 of AAQ89265 (SEQ ID NO:781), which also corresponds to amino acids 1-95 of Z41644_PEA_1_P10 (SEQ ID NO:1313), and a second amino acid sequence being at least 70%, optionally at least 80%, preferably at least 85%, more preferably at least 90% and most preferably at least 95% homologous to a polypeptide having the sequence YAPPLLT-FLPTRPSCGSQDGKGPPHQVI (SEQ ID NO: 1772) corresponding to amino acids 96-123 of Z41644_PEA_1_P10 (SEQ ID NO:1313), wherein said first and second amino acid sequences are contiguous and in a sequential order.

2. An isolated polypeptide encoding for a tail of Z41644_PEA_1_P10 (SEQ ID NO:1313), comprising a polypeptide being at least 70%, optionally at least about 80%, preferably at least about 85%, more preferably at least about 90% and most preferably at least about 95% homologous to the sequence YAPPLLTFLPTRPSCGSQDGKGPPHQVI (SEQ ID NO:1772) in Z41644_PEA_1_P10 (SEQ ID NO:1313).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z41644_PEA_1_P10 (SEQ ID NO:1313) also has the following non-silent SNPs (Single Nucleotide Polymorphisms) as listed in Table 311, (given according to their position(s) on the amino acid sequence, with the alternative amino acid(s) listed; the last column indicates whether the SNP is known or not; the presence of known SNPs in variant protein Z41644_PEA_1_P 10(SEQ ID NO:1313) sequence provides support for the deduced sequence of this variant protein according to the present invention).

TABLE 311

Amino acid mutations

| SNP position(s) on amino acid sequence | Alternative amino acid(s) | Previously known SNP? |
|---|---|---|
| 32 | P -> H | Yes |
| 64 | S -> | No |
| 80 | T -> A | No |
| 80 | T -> P | No |

Variant protein Z41644_PEA_1_P10 (SEQ ID NO:1313) is encoded by the following transcript(s): Z41644_PEA_1_T5 (SEQ ID NO:35), for which the sequence(s) is/are given at the end of the application. The coding portion of transcript Z41644_PEA_1_T5 (SEQ ID NO:35) is shown in bold; this coding portion starts at position 744 and ends at position 1112. The transcript also has the following SNPs as listed in Table 312 (given according to their position on the nucleotide sequence, with the alternative nucleic acid listed; the last column indicates whether the SNP is known or not; the presence of known SNPs in variant protein Z41644_PEA_1_P10 (SEQ ID NO:1313) sequence provides support for the deduced sequence of this variant protein according to the present invention).

TABLE 312

Nucleic acid SNPs

| SNP position on nucleotide sequence | Alternative nucleic acid | Previously known SNP? |
|---|---|---|
| 102 | A -> G | Yes |
| 572 | C -> | No |
| 3707 | C -> T | Yes |
| 3735 | C -> T | Yes |
| 4079 | G -> A | No |
| 4123 | G -> A | Yes |
| 4233 | A -> G | Yes |
| 4328 | C -> | No |
| 4350 | A -> G | Yes |
| 4376 | G -> A | Yes |
| 4390 | A -> G | Yes |
| 4619 | G -> T | Yes |
| 838 | C -> A | Yes |
| 4754 | C -> T | No |
| 4757 | C -> A | No |
| 4794 | T -> G | No |
| 4827 | G -> | No |
| 934 | C -> | No |
| 981 | A -> C | No |
| 981 | A -> G | No |
| 1817 | A -> C | Yes |
| 2546 | T -> | No |
| 2684 | T -> A | No |
| 2885 | T -> C | Yes |

As noted above, cluster Z41644 features 21 segment(s), which were listed in Table 307 above and for which the sequence(s) are given at the end of the application. These segment(s) are portions of nucleic acid sequence(s) which are described herein separately because they are of particular interest. A description of each segment according to the present invention is now provided.

Segment cluster Z41644_PEA_1_node_0 (SEQ ID NO:1234) according to the present invention is supported by 53 libraries. The number of libraries was determined as previously described. This segment can be found in the following transcript(s): Z41644_PEA_1_T5 (SEQ ID NO:35). Table 313 below describes the starting and ending position of this segment on each transcript.

TABLE 313

Segment location on transcripts

| Transcript name | Segment starting position | Segment ending position |
|---|---|---|
| Z41644_PEA_1_T5 (SEQ ID NO:35) | 1 | 616 |

Segment cluster Z41644_PEA_1_node_11 (SEQ ID NO:1235) according to the present invention is supported by 9 libraries. The number of libraries was determined as previously described. This segment can be found in the following transcript(s): Z41644_PEA_1_T5 (SEQ ID NO:35). Table 314 below describes the starting and ending position of this segment on each transcript.

TABLE 314

Segment location on transcripts

| Transcript name | Segment starting position | Segment ending position |
|---|---|---|
| Z41644_PEA_1_T5 (SEQ ID NO:35) | 1 | 616 |

Segment cluster Z41644_PEA_1_node_12 (SEQ ID NO:1236) according to the present invention is supported by 6 libraries. The number of libraries was determined as previously described. This segment can be found in the following transcript(s): Z41644_PEA_1_T5 (SEQ ID NO:35). Table 315 below describes the starting and ending position of this segment on each transcript.

TABLE 315

Segment location on transcripts

| Transcript name | Segment starting position | Segment ending position |
|---|---|---|
| Z41644_PEA_1_T5 (SEQ ID NO:35) | 2090 | 2350 |

Segment cluster Z41644_PEA_1_node_15 (SEQ ID NO:1237) according to the present invention is supported by 23 libraries. The number of libraries was determined as previously described. This segment can be found in the following transcript(s): Z41644_PEA_1_T5 (SEQ ID NO:35). Table 316 below describes the starting and ending position of this segment on each transcript.

TABLE 316

Segment location on transcripts

| Transcript name | Segment starting position | Segment ending position |
|---|---|---|
| Z41644_PEA_1_T5 (SEQ ID NO:35) | 2368 | 3728 |

Segment cluster Z41644_PEA_1_node_20 (SEQ ID NO:1238) according to the present invention is supported by 260 libraries. The number of libraries was determined as previously described. This segment can be found in the following transcript(s): Z41644_PEA_1_T5 (SEQ ID NO:35). Table 317 below describes the starting and ending position of this segment on each transcript.

TABLE 317

Segment location on transcripts

| Transcript name | Segment starting position | Segment ending position |
|---|---|---|
| Z41644_PEA_1_T5 (SEQ ID NO:35) | 3938 | 4506 |

Segment cluster Z41644_PEA_1_node_24 (SEQ ID NO:1239) according to the present invention is supported by 185 libraries. The number of libraries was determined as previously described. This segment can be found in the following transcript(s): Z41644_PEA_1_T5 (SEQ ID NO:35). Table 318 below describes the starting and ending position of this segment on each transcript.

TABLE 318

Segment location on transcripts

| Transcript name | Segment starting position | Segment ending position |
|---|---|---|
| Z41644_PEA_1_T5 (SEQ ID NO:35) | 4637 | 4799 |

According to an optional embodiment of the present invention, short segments related to the above cluster are also provided. These segments are up to about 120 bp in length, and so are included in a separate description.

Segment cluster Z41644_PEA_1_node_1 (SEQ ID NO:1240) according to the present invention is supported by 53 libraries. The number of libraries was determined as previously described. This segment can be found in the following transcript(s): Z41644_PEA_1_T5 (SEQ ID NO:35). Table 39 below describes the starting and ending position of this segment on each transcript.

TABLE 319

Segment location on transcripts

| Transcript name | Segment starting position | Segment ending position |
|---|---|---|
| Z41644_PEA_1_T5 (SEQ ID NO:35) | 617 | 697 |

Segment cluster Z41644_PEA_1_node_10 (SEQ ID NO:1241) according to the present invention is supported by 138 libraries. The number of libraries was determined as previously described. This segment can be found in the following transcript(s): Z41644_PEA_1_T5 (SEQ ID NO:35). Table 320 below describes the starting and ending position of this segment on each transcript.

TABLE 320

Segment location on transcripts

| Transcript name | Segment starting position | Segment ending position |
|---|---|---|
| Z41644_PEA_1_T5 (SEQ ID NO:35) | 972 | 1027 |

Segment cluster Z41644_PEA_1_node_13 (SEQ ID NO:1242) according to the present invention can be found in the following transcript(s): Z41644_PEA_1_T5 (SEQ ID NO:35). Table 321 below describes the starting and ending position of this segment on each transcript.

TABLE 321

Segment location on transcripts

| Transcript name | Segment starting position | Segment ending position |
|---|---|---|
| Z41644_PEA_1_T5 (SEQ ID NO:35) | 2351 | 2367 |

Segment cluster Z41644_PEA_1_node_16 (SEQ ID NO:1243) according to the present invention is supported by 152 libraries. The number of libraries was determined as previously described. This segment can be found in the following transcript(s): Z41644_PEA_1_T5 (SEQ ID NO:35). Table 322 below describes the starting and ending position of this segment on each transcript.

TABLE 322

Segment location on transcripts

| Transcript name | Segment starting position | Segment ending position |
|---|---|---|
| Z41644_PEA_1_T5 (SEQ ID NO:35) | 3729 | 3809 |

Segment cluster Z41644_PEA_1_node_17 (SEQ ID NO:1244) according to the present invention can be found in the following transcript(s): Z41644_PEA_1_T5 (SEQ ID NO:35). Table 323 below describes the starting and ending position of this segment on each transcript.

TABLE 323

Segment location on transcripts

| Transcript name | Segment starting position | Segment ending position |
|---|---|---|
| Z41644_PEA_1_T5 (SEQ ID NO:35) | 3810 | 3829 |

Segment cluster Z41644_PEA_1_node_19 (SEQ ID NO:1245) according to the present invention is supported by 112 libraries. The number of libraries was determined as previously described. This segment can be found in the following transcript(s): Z41644_PEA_1_T5 (SEQ ID NO:35). Table 324 below describes the starting and ending position of this segment on each transcript.

TABLE 324

Segment location on transcripts

| Transcript name | Segment starting position | Segment ending position |
|---|---|---|
| Z41644_PEA_1_T5 (SEQ ID NO:35) | 3830 | 3937 |

Segment cluster Z41644_PEA_1_node_2 (SEQ ID NO:1246) according to the present invention is supported by 58 libraries. The number of libraries was determined as previously described. This segment can be found in the following transcript(s): Z41644_PEA_1_T5 (SEQ ID NO:35). Table 325 below describes the starting and ending position of this segment on each transcript.

TABLE 325

Segment location on transcripts

| Transcript name | Segment starting position | Segment ending position |
|---|---|---|
| Z41644_PEA_1_T5 (SEQ ID NO:35) | 698 | 737 |

Segment cluster Z41644_PEA_1_node_21 (SEQ ID NO:1247) according to the present invention can be found in the following transcript(s): Z41644_PEA_1_T5 (SEQ ID NO:35). Table 326 below describes the starting and ending position of this segment on each transcript.

TABLE 326

Segment location on transcripts

| Transcript name | Segment starting position | Segment ending position |
|---|---|---|
| Z41644_PEA_1_T5 (SEQ ID NO:35) | 4507 | 4529 |

Segment cluster Z41644_PEA_1_node_22 (SEQ ID NO:1248) according to the present invention is supported by 164 libraries. The number of libraries was determined as previously described. This segment can be found in the following transcript(s): Z41644_PEA_1_T5 (SEQ ID NO:35). Table 327 below describes the starting and ending position of this segment on each transcript.

TABLE 327

Segment location on transcripts

| Transcript name | Segment starting position | Segment ending position |
|---|---|---|
| Z41644_PEA_1_T5 (SEQ ID NO:35) | 4530 | 4582 |

Segment cluster Z41644_PEA_1_node_23 (SEQ ID NO:1249) according to the present invention is supported by 169 libraries. The number of libraries was determined as previously described. This segment can be found in the following transcript(s): Z41644_PEA_1_T5 (SEQ ID NO:35). Table 328 below describes the starting and ending position of this segment on each transcript.

TABLE 328

Segment location on transcripts

| Transcript name | Segment starting position | Segment ending position |
|---|---|---|
| Z41644_PEA_1_T5 (SEQ ID NO:35) | 4583 | 4636 |

Segment cluster Z41644_PEA_1_node_25 (SEQ ID NO:1250) according to the present invention is supported by 138 libraries. The number of libraries was determined as previously described. This segment can be found in the following transcript(s): Z41644_PEA_1_T5 (SEQ ID NO:35). Table 329 below describes the starting and ending position of this segment on each transcript.

TABLE 329

Segment location on transcripts

| Transcript name | Segment starting position | Segment ending position |
|---|---|---|
| Z41644_PEA_1_T5 (SEQ ID NO:35) | 4800 | 4902 |

Segment cluster Z41644_PEA_1_node_3 (SEQ ID NO: 1251) according to the present invention is supported by 75 libraries. The number of libraries was determined as previously described. This segment can be found in the following transcript(s): Z41644_PEA_1_T5 (SEQ ID NO:35). Table 330 below describes the starting and ending position of this segment on each transcript.

TABLE 330

Segment location on transcripts

| Transcript name | Segment starting position | Segment ending position |
|---|---|---|
| Z41644_PEA_1_T5 (SEQ ID NO:35) | 738 | 773 |

Segment cluster Z41644_PEA_1_node_4 (SEQ ID NO:1252) according to the present invention is supported by 61 libraries. The number of libraries was determined as previously described. This segment can be found in the following transcript(s): Z41644_PEA_1_T5 (SEQ ID NO:35). Table 331 below describes the starting and ending position of this segment on each transcript.

TABLE 331

Segment location on transcripts

| Transcript name | Segment starting position | Segment ending position |
|---|---|---|
| Z41644_PEA_1_T5 (SEQ ID NO:35) | 774 | 807 |

Segment cluster Z41644_PEA_1_node_6 (SEQ ID NO:1253) according to the present invention is supported by 101 libraries. The number of libraries was determined as previously described. This segment can be found in the following transcript(s): Z41644_PEA_1_T5 (SEQ ID NO:35). Table 332 below describes the starting and ending position of this segment on each transcript.

TABLE 332

Segment location on transcripts

| Transcript name | Segment starting position | Segment ending position |
|---|---|---|
| Z41644_PEA_1_T5 (SEQ ID NO:35) | 808 | 913 |

Segment cluster Z41644_PEA_1_node_9 (SEQ ID NO:1254) according to the present invention is supported by 134 libraries. The number of libraries was determined as previously described. This segment can be found in the following transcript(s): Z41644_PEA_1_T5 (SEQ ID NO:35). Table 333 below describes the starting and ending position of this segment on each transcript.

TABLE 333

Segment location on transcripts

| Transcript name | Segment starting position | Segment ending position |
|---|---|---|
| Z41644_PEA_1_T5 (SEQ ID NO:35) | 914 | 971 |

Variant protein alignment to the previously known protein:

Sequence name: /tmp/p5SSvhT9Xp/HQeIMsUrfm: SZ14_HUMAN (SEQ ID NO:1429)

Sequence documentation:

Alignment of: Z41644_PEA_1_P10 (SEQ ID NO:1313) x SZ14_HUMAN (SEQ ID NO:1429) . . .

Alignment segment 1/1:

| Quality: | 953.00 | Escore: | 0 |
|---|---|---|---|
| Matching length: | 95 | Total length: 95 | |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MRLLAAALLLLLLALYTARVDGSKCKCSRKGPKIRYSDVKKLEMKPKYPH 50
   |||||||||||||||||||||||||||||||||||||||||||||||||
 1 MRLLAAALLLLLLALYTARVDGSKCKCSRKGPKIRYSDVKKLEMKPKYPH 50

51 CEEKMVIITTKSVSRYRGQEHVCLHPKLQSTKRFIKWYNAWNEKRR     95
   |||||||||||||||||||||||||||||||||||||||||||||
51 CEEKMVIITTKSVSRYRGQEHVCLHPKLQSTKRFIKWYNAWNEKRR     95
```

Sequence name: /tmp/p5SSvhT9Xp/HQeIMsUrfm:Q9NS21 (SEQ ID NO:1706)

Sequence documentation:

Alignment of: Z41644_PEA_1_P10 (SEQ ID NO:1313) x Q9NS21 (SEQ ID NO:1706)

Alignment segment 1/1:

| | | | |
|---|---|---|---|
| Quality: | 957.00 | Escore: | 0 |
| Matching length: | 96 | Total length: | 96 |
| Matching Percent Similarity: | 100.00 | Matching Percent Identity: | 98.96 |
| Total Percent Similarity: | 100.00 | Total Percent Identity: | 98.96 |
| Gaps: | 0 | | |

Alignment:

```
 1 MRLLAAALLLLLLALYTARVDGSKCKCSRKGPKIRYSDVKKLEMKPKYPH  50
   ||||||||||||||||||||||||||||||||||||||||||||||||||
13 MRLLAAALLLLLLALYTARVDGSKCKCSRKGPKIRYSDVKKLEMKPKYPH  62

51 CEEKMVIITTKSVSRYRGQEHCLHPKLQSTKRFIKWYNAWNEKRRY      96
   |||||||||||||||||||||||:||||||||||||||||||||||
63 CEEKMVIITTKSVSRYRGQEHCLHPKLQSTKRFIKWYNAWNEKRRY     108
```

Sequence name: /tmp/p5SSvhT9Xp/HQeIMsUrfm:AAQ89265 (SEQ ID NO:781)

Sequence documentation:

Alignment of: Z41644_PEA_1_P10 (SEQ ID NO:1313) x AAQ89265 (SEQ ID NO:781)

Alignment segment 1/1:

| | | | |
|---|---|---|---|
| Quality: | 953.00 | Escore: | 0 |
| Matching length: | 95 | Total length: | 95 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 1 MRLLAAALLLLLLALYTARVDGSKCKCSRKGPKIRYSDVKKLEMKPKYPH  50
   ||||||||||||||||||||||||||||||||||||||||||||||||||
13 MRLLAAALLLLLLALYTARVDGSKCKCSRKGPKIRYSDVKKLEMKPKYPH  62

51 CEEKMVIITTKSVSRYRGQEHCLHPKLQSTKRFIKWYNAWNEKRR       95
   |||||||||||||||||||||||||||||||||||||||||||||
63 CEEKMVIITTKSVSRYRGQEHCLHPKLQSTKRFIKWYNAWNEKRR      107
```

Description for Cluster Z44808

Cluster Z44808 features 5 transcript(s) and 21 segment(s) of interest, the names for which are given in Tables 334 and 335, respectively, the sequences themselves are given at the end of the application. The selected protein variants are given in table 336.

TABLE 334

Transcripts of interest

| Transcript Name | Sequence ID No. |
|---|---|
| Z44808_PEA_1_T11 | 36 |
| Z44808_PEA_1_T4 | 37 |
| Z44808_PEA_1_T5 | 38 |
| Z44808_PEA_1_T8 | 39 |
| Z44808_PEA_1_T9 | 40 |

TABLE 335

Segments of interest

| Segment Name | Sequence ID No. |
|---|---|
| Z44808_PEA_1_node_0 | 461 |
| Z44808_PEA_1_node_16 | 462 |
| Z44808_PEA_1_node_2 | 463 |
| Z44808_PEA_1_node_24 | 464 |
| Z44808_PEA_1_node_32 | 465 |
| Z44808_PEA_1_node_33 | 466 |
| Z44808_PEA_1_node_36 | 467 |
| Z44808_PEA_1_node_37 | 468 |
| Z44808_PEA_1_node_41 | 469 |
| Z44808_PEA_1_node_11 | 470 |
| Z44808_PEA_1_node_13 | 471 |
| Z44808_PEA_1_node_18 | 472 |
| Z44808_PEA_1_node_22 | 473 |

TABLE 335-continued

Segments of interest

| Segment Name | Sequence ID No. |
|---|---|
| Z44808_PEA_1_node_26 | 474 |
| Z44808_PEA_1_node_30 | 475 |

TABLE 335-continued

Segments of interest

| Segment Name | Sequence ID No. |
|---|---|
| Z44808_PEA_1_node_34 | 476 |
| Z44808_PEA_1_node_35 | 477 |
| Z44808_PEA_1_node_39 | 478 |
| Z44808_PEA_1_node_4 | 479 |
| Z44808_PEA_1_node_6 | 480 |
| Z44808_PEA_1_node_8 | 481 |

TABLE 336

Proteins of interest

| Protein Name | Sequence ID No. |
|---|---|
| Z44808_PEA_1_P5 | 1314 |
| Z44808_PEA_1_P6 | 1315 |
| Z44808_PEA_1_P7 | 1316 |
| Z44808_PEA_1_P11 | 1317 |

These sequences are variants of the known protein SPARC related modular calcium-binding protein 2 precursor (SwissProt accession identifier SMO2_HUMAN; known also according to the synonyms Secreted modular calcium-binding protein 2; SMOC-2; Smooth muscle-associated protein 2; SMAP-2; MSTP117), SEQ ID NO: 1430, referred to herein as the previously known protein.

Protein SPARC related modular calcium-binding protein 2 precursor (SEQ ID NO:1430) is known or believed to have the following function(s): calcium binding. The sequence for protein SPARC related modular calcium-binding protein 2 precursor is given at the end of the application, as "SPARC related modular calcium-binding protein 2 precursor amino acid sequence". Known polymorphisms for this sequence are as shown in Table 337.

TABLE 337

Amino acid mutations for Known Protein

| SNP position(s) on amino acid sequence | Comment |
|---|---|
| 169-170 | KT -> TR |
| 212 | S -> P |
| 429-446 | TPRGHAESTSNRQPRKQG -> RSKRNL |
| 434 | A -> V |
| 439 | N -> Y |

Protein SPARC related modular calcium-binding protein 2 precursor (SEQ ID NO:1430) localization is believed to be Secreted.

Cluster Z44808 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 28 refer to weighted expression of ESTs in each category, as "parts per million" (ratio of the expression of ESTs for a particular cluster to the expression of all ESTs in that category, according to parts per million).

Figure 28:
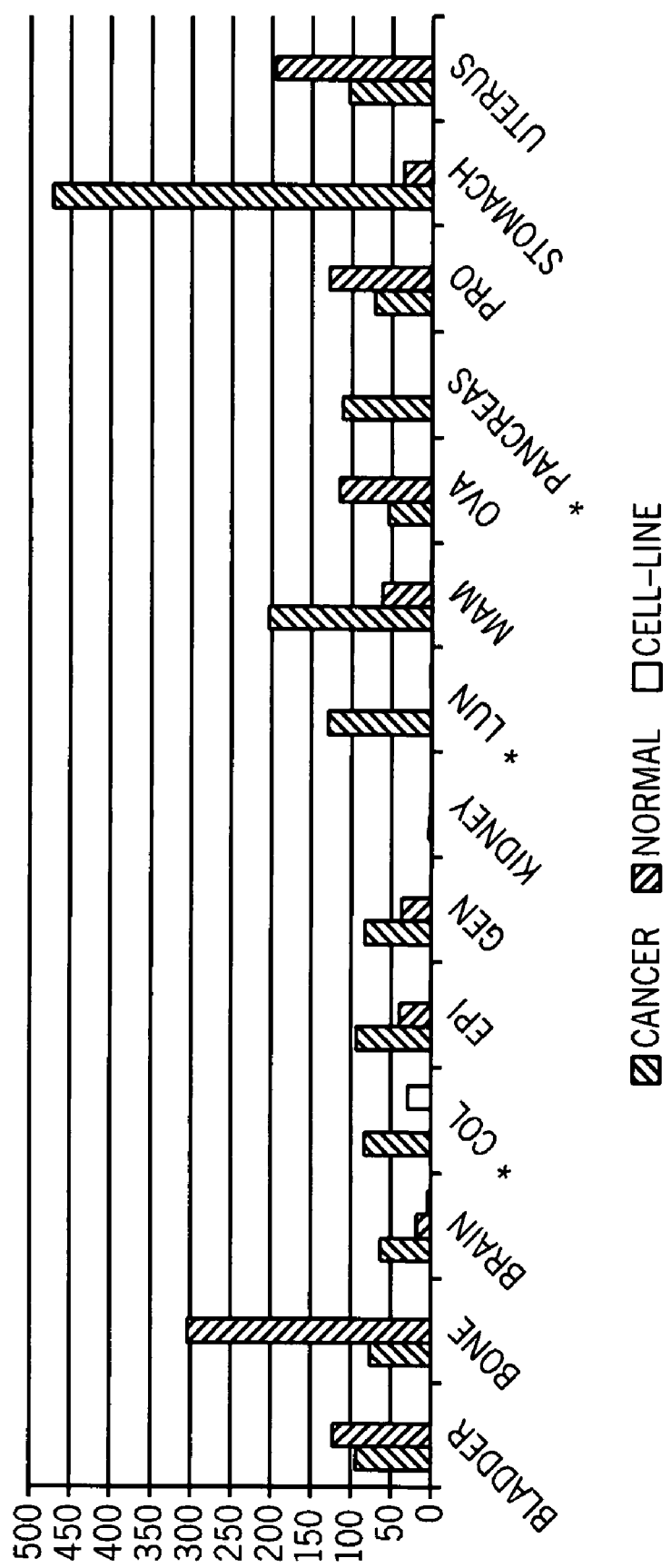
FIG. 28 is a histogram showing Cancer and cell-line vs. normal tissue expression for Cluster Z44808, demonstrating overexpression in colorectal cancer, lung cancer and pancreas carcinoma.

Overall, the following results were obtained as shown with regard to the histograms in FIG. 28 and Table 338. This cluster is overexpressed (at least at a minimum level) in the following pathological conditions: colorectal cancer, lung cancer and pancreas carcinoma.

TABLE 338

Normal tissue distribution

| Name of Tissue | Number |
|---|---|
| bladder | 123 |
| bone | 304 |
| brain | 18 |
| colon | 0 |
| epithelial | 40 |
| general | 37 |
| kidney | 2 |
| lung | 0 |
| breast | 61 |
| ovary | 116 |
| pancreas | 0 |
| prostate | 128 |
| stomach | 36 |
| uterus | 195 |

TABLE 339

P values and ratios for expression in cancerous tissue

| Name of Tissue | P1 | P2 | SP1 | R3 | SP2 | R4 |
|---|---|---|---|---|---|---|
| bladder | 6.8e-01 | 7.6e-01 | 7.7e-01 | 0.8 | 9.1e-01 | 0.6 |
| bone | 7.0e-01 | 8.8e-01 | 9.9e-01 | 0.3 | 1 | 0.2 |
| brain | 6.8e-01 | 7.2e-01 | 3.0e-02 | 2.6 | 1.7e-01 | 1.6 |
| colon | 9.2e-03 | 1.3e-02 | 1.2e-01 | 3.6 | 1.6e-01 | 3.1 |
| epithelial | 2.1e-02 | 4.0e-01 | 1.0e-04 | 1.9 | 2.7e-01 | 1.0 |
| general | 2.6e-02 | 7.2e-01 | 4.9e-07 | 1.9 | 3.0e-01 | 1.0 |
| kidney | 7.3e-01 | 8.1e-01 | 1 | 1.0 | 1 | 1.0 |
| lung | 4.0e-03 | 1.8e-02 | 8.0e-04 | 12.2 | 2.1e-02 | 6.0 |
| breast | 4.8e-01 | 6.1e-01 | 9.8e-02 | 2.0 | 3.9e-01 | 1.2 |
| ovary | 8.1e-01 | 8.3e-01 | 9.1e-01 | 0.6 | 9.7e-01 | 0.5 |
| pancreas | 1.2e-01 | 2.1e-01 | 1.0e-03 | 6.5 | 5.9e-03 | 4.6 |
| prostate | 8.4e-01 | 8.9e-01 | 9.0e-01 | 0.6 | 9.8e-01 | 0.4 |
| stomach | 5.0e-01 | 8.7e-01 | 9.6e-04 | 1.5 | 1.9e-01 | 0.8 |
| uterus | 6.7e-01 | 7.9e-01 | 9.2e-01 | 0.5 | 1 | 0.3 |

As noted above, cluster Z44808 features 5 transcript(s), which were listed in Table 334 above. These transcript(s) encode for protein(s) which are variant(s) of protein SPARC related modular calcium-binding protein 2 precursor (SEQ ID NO:1430). A description of each variant protein according to the present invention is now provided.

Variant protein Z44808_PEA_1_P5 (SEQ ID NO:1314) according to the present invention has an amino acid sequence as given at the end of the application; it is encoded by transcript(s) Z44808_PEA_1_T4 (SEQ ID NO:37). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison report between Z44808_PEA_1_P5 (SEQ ID NO:1314) and SMO2_HUMAN (SEQ ID NO:1430):

1. An isolated chimeric polypeptide encoding for Z44808_PEA_1_P5 (SEQ ID NO:1314), comprising a first amino acid sequence being at least 90% homologous to MLLPQLCWLPLLAGLLPPVPAQKFSALTFLRVDQDKDKD-CSLDCAGSPQKPLCASDGRTFLSRCEFQRAK CKD-PQLEIAYRGNCKDVSRCVAERKYTQEQARKEFQQV-FIPECNDDGTYSQVQCHSYTGYCWCVTPNGR PISG-TAVAHKTPRCPGSVNEKLPQREGTGKTDDAAAPAL-ETQPQGDEEDIASRYPTLWTEQVKSRQNKTN KNS-VSSCDQEHQSALEEAKQPKNDNVVIPECAHGGLY- KPVQCHPSTGYCWCVLVDTGRPIPGTSTRYEQP KCDNTARAHPAKARDLYKGRQLQGCPGAKKHEF-LTSVLDALSTDMVHAASDPSSSSGRLSEPDPSHTLEE RVVHWYFKLLDKNSSGDIGKKEIKPFKRFLRKKSKP-KKCVKKFVEYCDVNNDKSISVQELMGCLGVAKE DGKADTKKRHTPRGHAESTSNRQ corresponding to amino acids 1-441 of SMO2_HUMAN (SEQ ID NO:1430), which also corresponds to amino acids 1-441 of Z44808_PEA_1_P5 (SEQ ID NO:1314), and a second amino acid sequence being at least 70%, optionally at least 80%, preferably at least 85%, more preferably at least 90% and most preferably at least 95% homologous to a polypeptide having the sequence DAMVVSSRPKATTHRK-SRTLSRR (SEQ ID NO: 1751) corresponding to amino acids 442-464 of Z44808_PEA_1_P5 (SEQ ID NO:1314), wherein said first and second amino acid sequences are contiguous and in a sequential order.

2. An isolated polypeptide encoding for a tail of Z44808_PEA_1_P5 (SEQ ID NO:1314), comprising a polypeptide being at least 70%, optionally at least about 80%, preferably at least about 85%, more preferably at least about 90% and most preferably at least about 95% homologous to the sequence DAMVVSSRPKATTHRKSRTLSRR (SEQ ID NO: 1751) in Z44808_PEA_1_P5 (SEQ ID NO:1314).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P5 (SEQ ID NO:1314) is encoded by the following transcript(s): Z44808_PEA_1_T4 (SEQ ID NO:37), for which the sequence(s) is/are given at the end of the application. The coding portion of transcript Z44808_PEA_1_T4 (SEQ ID NO:37) is shown in bold; this coding portion starts at position 586 and ends at position 1977. The transcript also has the following SNPs as listed in Table 340 (given according to their position on the nucleotide sequence, with the alternative nucleic acid listed; the last column indicates whether the SNP is known or not; the presence of known SNPs in variant protein Z44808_PEA_1_P5 (SEQ ID NO:1314) sequence provides support for the deduced sequence of this variant protein according to the present invention).

TABLE 340

Nucleic acid SNPs

| SNP position on nucleotide sequence | Alternative nucleic acid | Previously know SNP? |
|---|---|---|
| 549 | A -> G | No |
| 648 | T -> G | No |
| 4403 | G -> T | No |
| 4456 | G -> A | Yes |
| 4964 | G -> C | Yes |
| 1025 | C -> | No |
| 1677 | T -> C | No |
| 2691 | C -> T | Yes |
| 3900 | T -> C | No |
| 3929 | G -> A | Yes |
| 4099 | G -> T | Yes |
| 4281 | T -> C | No |
| 4319 | G -> C | Yes |

Variant protein Z44808_PEA_1_P6 (SEQ ID NO:1315) according to the present invention has an amino acid sequence as given at the end of the application; it is encoded by transcript(s) Z44808_PEA_1_T5 (SEQ ID NO:38). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison report between Z44808_PEA_1_P6 (SEQ ID NO:1315) and SMO2_HUMAN (SEQ ID NO:1430):

1. An isolated chimeric polypeptide encoding for Z44808_PEA_1_P6 (SEQ ID NO:1315), comprising a first amino acid sequence being at least 90% homologous to MLL-PQLCWLPLLAGLLPPVPAQKFSALTFLRVDQDKDK-DCSLDCAGSPQKPLCASDGRTFLSRCEFQRAK CKD-PQLEIAYRGNCKDVSRCVAERKYTQEQARKEFQQV-FIPECNDDGTYSQVQCHSYTGYCWCVTPNGR PISG-TAVAHKTPRCPGSVNEKLPQREGTGKTDDAAAPALE-TQPQGDEEDIASRYPTLWTEQVKSRQNKTN KNS-VSSCDQEHQSALEEAKQPKNDNVVIPECAHGGLYK-PVQCHPSTGYCWCVLVDTGRPIPGTSTRYEQP KCDN-TARAHPAKARDLYKGRQLQGCPGAKKHEFLTSVL-DALSTDMVHAASDPSSSSGRLSEPDPSHTLEE RVVH-WYFKLLDKNSSGDIGKKEIKPFKRFLRKKSKPKK-CVKKFVEYCDVNNDKSISVQELMGCLGVAKE DGKADTKKRH corresponding to amino acids 1-428 of SMO2_HUMAN (SEQ ID NO:1430), which also corresponds to amino acids 1-428 of Z44808_PEA_1_P6 (SEQ ID NO:1315), and a second amino acid sequence being at least 70%, optionally at least 80%, preferably at least 85%, more preferably at least 90% and most preferably at least 95% homologous to a polypeptide having the sequence RSKRNL (SEQ ID NO:1752) corresponding to amino acids 429-434 of Z44808_PEA_1_P6 (SEQ ID NO:1315), wherein said first and second amino acid sequences are contiguous and in a sequential order.

2. An isolated polypeptide encoding for a tail of Z44808_PEA_1_P6 (SEQ ID NO:1315), comprising a polypeptide being at least 70%, optionally at least about 80%, preferably at least about 85%, more preferably at least about 90% and most preferably at least about 95% homologous to the sequence RSKRNL (SEQ ID NO:1752) in Z44808_PEA_1_P6 (SEQ ID NO:1315).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P6 (SEQ ID NO:1315) also has the following non-silent SNPs (Single Nucleotide Polymorphisms) as listed in Table 341, (given according to their position(s) on the amino acid sequence, with the alternative amino acid(s) listed; the last column indicates whether the SNP is known or not; the presence of known SNPs in variant protein Z44808_PEA_1_P6 (SEQ ID NO:1315) sequence provides support for the deduced sequence of this variant protein according to the present invention).

TABLE 341

Amino acid mutations

| SNP position(s) on amino acid sequence | Alternative amino acid(s) | Previously known SNP? |
|---|---|---|
| 147 | A -> | No |

Variant protein Z44808_PEA_1_P6 (SEQ ID NO:1315) is encoded by the following transcript(s): Z44808_PEA_1_T5 (SEQ ID NO:38), for which the sequence(s) is/are given at the end of the application. The coding portion of transcript Z44808_PEA_1_T5 (SEQ ID NO:38) is shown in bold; this coding portion starts at position 586 and ends at position 1887. The transcript also has the following SNPs as listed in Table 342 (given according to their position on the nucleotide sequence, with the alternative nucleic acid listed; the last column indicates whether the SNP is known or not; the presence of known SNPs in variant protein Z44808_PEA_1_P6 (SEQ ID NO:1315) sequence provides support for the deduced sequence of this variant protein according to the present invention).

TABLE 342

Nucleic acid SNPs

| SNP position on nucleotide sequence | Alternative nucleic acid | Previously know SNP? |
|---|---|---|
| 549 | A -> G | No |
| 648 | T -> G | No |
| 2866 | G -> A | Yes |
| 3374 | G -> C | Yes |
| 1025 | C -> | No |
| 1677 | T -> C | No |
| 2310 | T -> C | No |
| 2339 | G -> A | Yes |
| 2509 | G -> T | Yes |
| 2691 | T -> C | No |
| 2729 | G -> C | Yes |
| 2813 | G -> T | No |

Variant protein Z44808_PEA_1_P7 (SEQ ID NO:1316) according to the present invention has an amino acid sequence as given at the end of the application; it is encoded by transcript(s) Z44808_PEA_1_T9 (SEQ ID NO:40). An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison report between Z44808_PEA_1_P7 (SEQ ID NO:1316) and SMO2_HUMAN (SEQ ID NO:1430):

1. An isolated chimeric polypeptide encoding for Z44808_PEA_1_P7 (SEQ ID NO:1316), comprising a first amino acid sequence being at least 90% homologous to MLLPQLCWLPLLAGLLPPVPAQKFSALTFL-RVDQDKDKDCSLDCAGSPQKPLCASDGRTFLSRC-EFQRAK CKDPQLEIAYRGNCKDVSRCVAERKYTQ-EQARKEFQQVFIPECNDDGTYSQVQCHSYTGYCW-CVTPNGR PISGTAVAHKTPRCPGSVNEKLPQREGT-GKTDDAAAPALETQPQGDEEDIASRYPTLWTEQV-KSRQNKTN KNSVSSCDQEHQSALEEAKQPKNDNV-VIPECAHGGLYKPVQCHPSTGYCWCVLVDTGRPIP-GTSTRYEQP KCDNTARAHPAKARDLYKGRQLQGCP-GAKKHEFLTSVLDALSTDMVHAASDPSSSSGRLSE-PDPSHTLEE RVVHWYFKLLDKNSSGDIGKKEIK-PFKRFLRKKSKPKKCVKKFVEYCDVNNDKSISV-QELMGCLGVAKE DGKADTKKRHTPRGHAESTSNRQ corresponding to amino acids 1-441 of SMO2_HUMAN (SEQ ID NO:1430), which also corresponds to amino acids 1-441 of Z44808_PEA_1_P7 (SEQ ID NO:1316), and a second amino acid sequence being at least 70%, optionally at least 80%, preferably at least 85%, more preferably at least 90% and most preferably at least 95% homologous to a polypeptide having the sequence LLWLRGKVSFYCF (SEQ ID NO:1753) corresponding to amino acids 442-454 of Z44808_PEA_1_P7 (SEQ ID NO:1316), wherein said first and second amino acid sequences are contiguous and in a sequential order.

2. An isolated polypeptide encoding for a tail of Z44808_PEA_1_P7 (SEQ ID NO:1316), comprising a polypeptide being at least 70%, optionally at least about 80%, preferably at least about 85%, more preferably at least about 90% and most preferably at least about 95% homologous to the sequence LLWLRGKVSFYCF (SEQ ID NO:1753) in Z44808_PEA_1_P7 (SEQ ID NO:1316).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P7 (SEQ ID NO:1316) also has the following non-silent SNPs (Single Nucleotide Polymorphisms) as listed in Table 343, (given according to their position(s) on the amino acid sequence, with the alternative amino acid(s) listed; the last column indicates whether the SNP is known or not; the presence of known SNPs in variant protein Z44808_PEA_1_P7 (SEQ ID NO:1316) sequence provides support for the deduced sequence of this variant protein according to the present invention).

TABLE 343

Amino acid mutations

| SNP position(s) on amino acid sequence | Alternative amino acid(s) | Previously known SNP? |
|---|---|---|
| 147 | A -> | No |

Variant protein Z44808_PEA_1_P7 (SEQ ID NO:1316) is encoded by the following transcript(s): Z44808_PEA_1_T9 (SEQ ID NO:40), for which the sequence(s) is/are given at the end of the application. The coding portion of transcript Z44808_PEA_1_T9 (SEQ ID NO:40) is shown in bold; this coding portion starts at position 586 and ends at position 1947. The transcript also has the following SNPs as listed in Table 344 (given according to their position on the nucleotide sequence, with the alternative nucleic acid listed; the last column indicates whether the SNP is known or not; the presence of known SNPs in variant protein Z44808_PEA_1_P7 (SEQ ID NO:1316) sequence provides support for the deduced sequence of this variant protein according to the present invention).

TABLE 344

Nucleic acid SNPs

| SNP position on nucleotide sequence | Alternative nucleic acid | Previously known SNP? |
|---|---|---|
| 549 | A -> G | No |
| 648 | T -> G | No |
| 1025 | C -> | No |
| 1677 | T -> C | No |
| 2169 | C -> A | Yes |

Variant protein Z44808_PEA_1_P11 (SEQ ID NO:1317) according to the present invention has an amino acid sequence as given at the end of the application; it is encoded by transcript(s) Z44808_PEA_1_T11 (SEQ ID NO:36). The identification of this transcript was performed using a non-EST based method for identification of alternative splicing, described in the following reference: "Sorek R et al., Genome Res. (2004) 14:1617-23." An alignment is given to the known protein (SPARC related modular calcium-binding protein 2 precursor (SEQ ID NO:1430)) at the end of the application. One or more alignments to one or more previously published protein sequences are given at the end of the application. A brief description of the relationship of the variant protein according to the present invention to each such aligned protein is as follows:

Comparison report between Z44808_PEA_1_P11 (SEQ ID NO:1317) and SMO2_HUMAN (SEQ ID NO:1430):

1. An isolated chimeric polypeptide encoding for Z44808_PEA_1_P11 (SEQ ID NO:1317), comprising a first amino acid sequence being at least 90% homologous to MLLPQLCWLPLLAGLLPPVPAQKFSALTFLRVDQDKDKDCSLDCAGSPQKPLCASDGRTFLSRCEFQRAK CKDPQLEIAYRGNCKDVSRCVAERKYTQEQARKEFQQVFIPECNDDGTYSQVQCHSYTGYCWCVTPNGR PISGTAVAHKTPRCPGSVNEKLPQREGTGKT corresponding to amino acids 1-170 of SMO2_HUMAN (SEQ ID NO:1430), which also corresponds to amino acids 1-170 of Z44808_PEA_1_P11 (SEQ ID NO:1317), and a second amino acid sequence being at least 90% homologous to DIASRYPTLWTEQVKSRQNKTNKNSVSSCDQEHQSALEEAKQPKNDNVVIPECAHGGLYKPVQCHPSTGY CWCVLVDTGRPIPGTSTRYEQPKCDNTARAHPAKARDLYKGRQLQGCPGAKKHEFLTSVLDALSTDMVH AASDPSSSGRLSEPDPSHTLEERVHWYFKLLDKNSSGDIGKKEIKPFKRFLRKKSKPKKCVKKFVEYCD VNNDKSISVQELMGCLGVAKEDGKADTKKRHTPRGHAESTSNRQPRKQG corresponding to amino acids 188-446 of SMO2_HUMAN (SEQ ID NO:1430), which also corresponds to amino acids 171-429 of Z44808_PEA_1_P11 (SEQ ID NO:1317), wherein said first and second amino acid sequences are contiguous and in a sequential order.

2. An isolated chimeric polypeptide encoding for an edge portion of Z44808_PEA_1_P11 (SEQ ID NO:1317), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 170-x to -170; and ending at any of amino acid numbers 171+((n-2)-x), in which x varies from 0 to n-2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z44808_PEA_1_P11 (SEQ ID NO:1317) also has the following non-silent SNPs (Single Nucleotide Polymorphisms) as listed in Table 345, (given according to their position(s) on the amino acid sequence, with the alternative amino acid(s) listed; the last column indicates whether the SNP is known or not; the presence of known SNPs in variant protein Z44808_PEA_1_P11 (SEQ ID NO:1317) sequence provides support for the deduced sequence of this variant protein according to the present invention).

TABLE 345

Amino acid mutations

| SNP position(s) on amino acid sequence | Alternative amino acid(s) | Previously known SNP? |
|---|---|---|
| 147 | A -> | No |

Variant protein Z44808_PEA_1_P11 (SEQ ID NO:1317) is encoded by the following transcript(s): Z44808_PEA_1_T11 (SEQ ID NO:36), for which the sequence(s) is/are given at the end of the application. The coding portion of transcript Z44808_PEA_1_T11 (SEQ ID NO:36) is shown in bold; this coding portion starts at position 586 and ends at position 1872. The transcript also has the following SNPs as listed in Table 346 (given according to their position on the nucleotide sequence, with the alternative nucleic acid listed; the last column indicates whether the SNP is known or not; the presence of known SNPs in variant protein Z44808_PEA_1_P11 (SEQ ID NO:1317) sequence provides support for the deduced sequence of this variant protein according to the present invention).

TABLE 346

Nucleic acid SNPs

| SNP position on nucleotide sequence | Alternative nucleic acid | Previously known SNP? |
|---|---|---|
| 549 | A -> G | No |
| 648 | T -> G | No |
| 2720 | G -> A | Yes |
| 3228 | G -> C | Yes |
| 1025 | C -> | No |
| 1626 | T -> C | No |
| 2164 | T -> C | No |
| 2193 | G -> A | Yes |
| 2363 | G -> T | Yes |
| 2545 | T -> C | No |
| 2583 | G -> C | Yes |
| 2667 | G -> T | No |

As noted above, cluster Z44808 features 21 segment(s), which were listed in Table 335 above and for which the sequence(s) are given at the end of the application. These segment(s) are portions of nucleic acid sequence(s) which are described herein separately because they are of particular interest. A description of each segment according to the present invention is now provided.

Segment cluster Z44808_PEA_1_node_0 (SEQ ID NO:1255) according to the present invention is supported by 29 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 347 below describes the starting and ending position of this segment on each transcript.

TABLE 347

Segment location on transcripts

| Transcript name | Segment starting position | Segment ending position |
|---|---|---|
| Z44808_PEA_1_T11 (SEQ ID NO:36) | 1 | 669 |
| Z44808_PEA_1_T4 (SEQ ID NO:37) | 1 | 669 |
| Z44808_PEA_1_T5 (SEQ ID NO:38) | 1 | 669 |
| Z44808_PEA_1_T8 (SEQ ID NO:39) | 1 | 669 |
| Z44808_PEA_1_T9 (SEQ ID NO:40) | 1 | 669 |

Segment cluster Z44808_PEA_1_node_16 (SEQ ID NO:1256) according to the present invention is supported by 39 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 348 below describes the starting and ending position of this segment on each transcript.

TABLE 348

Segment location on transcripts

| Transcript name | Segment starting position | Segment ending position |
|---|---|---|
| Z44808_PEA_1_T11 (SEQ ID NO:36) | 1172 | 1358 |
| Z44808_PEA_1_T4 (SEQ ID NO:37) | 1223 | 1409 |
| Z44808_PEA_1_T5 (SEQ ID NO:38) | 1223 | 1409 |
| Z44808_PEA_1_T8 (SEQ ID NO:39) | 1223 | 1409 |
| Z44808_PEA_1_T9 (SEQ ID NO:40) | 1223 | 1409 |

Segment cluster Z44808_PEA_1_node_2 (SEQ ID NO:1257) according to the present invention is supported by 34 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 349 below describes the starting and ending position of this segment on each transcript.

TABLE 349

Segment location on transcripts

| Transcript name | Segment starting position | Segment ending position |
|---|---|---|
| Z44808_PEA_1_T11 (SEQ ID NO:36) | 670 | 841 |
| Z44808_PEA_1_T4 (SEQ ID NO:37) | 670 | 841 |
| Z44808_PEA_1_T5 (SEQ ID NO:38) | 670 | 841 |
| Z44808_PEA_1_T8 (SEQ ID NO:39) | 670 | 841 |
| Z44808_PEA_1_T9 (SEQ ID NO:40) | 670 | 841 |

Segment cluster Z44808_PEA_1_node_24 (SEQ ID NO:1258) according to the present invention is supported by 52 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 350 below describes the starting and ending position of this segment on each transcript.

TABLE 350

Segment location on transcripts

| Transcript name | Segment starting position | Segment ending position |
|---|---|---|
| Z44808_PEA_1_T11 (SEQ ID NO:36) | 1545 | 1819 |
| Z44808_PEA_1_T4 (SEQ ID NO:37) | 1596 | 1870 |
| Z44808_PEA_1_T5 (SEQ ID NO:38) | 1596 | 1870 |
| Z44808_PEA_1_T8 (SEQ ID NO:39) | 1596 | 1870 |
| Z44808_PEA_1_T9 (SEQ ID NO:40) | 1596 | 1870 |

Segment cluster Z44808_PEA_1_node_32 (SEQ ID NO:1259) according to the present invention is supported by 17 libraries. The number of libraries was determined as previously described. This segment can be found in the following transcript(s): Z44808_PEA_1_T4 (SEQ ID NO:37) and Z44808_PEA_1_T8 (SEQ ID NO:39). Table 351 below describes the starting and ending position of this segment on each transcript.

TABLE 351

Segment location on transcripts

| Transcript name | Segment starting position | Segment ending position |
|---|---|---|
| Z44808_PEA_1_T4 (SEQ ID NO:37) | 1909 | 3593 |
| Z44808_PEA_1_T8 (SEQ ID NO:39) | 1909 | 2397 |

Segment cluster Z44808_PEA_1_node_33 (SEQ ID NO:1260) according to the present invention is supported by 133 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 352 below describes the starting and ending position of this segment on each transcript.

TABLE 352

Segment location on transcripts

| Transcript name | Segment starting position | Segment ending position |
|---|---|---|
| Z44808_PEA_1_T11 (SEQ ID NO:36) | 1858 | 2734 |
| Z44808_PEA_1_T4 (SEQ ID NO:37) | 3594 | 4470 |
| Z44808_PEA_1_T5 (SEQ ID NO:38) | 2004 | 2880 |

Segment cluster Z44808_PEA_1_node_36 (SEQ ID NO:1261) according to the present invention is supported by 117 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 353 below describes the starting and ending position of this segment on each transcript.

TABLE 353

Segment location on transcripts

| Transcript name | Segment starting position | Segment ending position |
|---|---|---|
| Z44808_PEA_1_T11 (SEQ ID NO:36) | 2829 | 3080 |
| Z44808_PEA_1_T4 (SEQ ID NO:37) | 4565 | 4816 |
| Z44808_PEA_1_T5 (SEQ ID NO:38) | 2975 | 3226 |

Segment cluster Z44808_PEA_1_node_37 (SEQ ID NO:1262) according to the present invention is supported by 120 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 354 below describes the starting and ending position of this segment on each transcript.

TABLE 354

Segment location on transcripts

| Transcript name | Segment starting position | Segment ending position |
|---|---|---|
| Z44808_PEA_1_T11 (SEQ ID NO:36) | 3081 | 3429 |
| Z44808_PEA_1_T4 (SEQ ID NO:37) | 4817 | 5165 |
| Z44808_PEA_1_T5 (SEQ ID NO:38) | 3227 | 3575 |

Segment cluster Z44808_PEA_1_node_41 (SEQ ID NO:1263) according to the present invention is supported by 2 libraries. The number of libraries was determined as previously described. This segment can be found in the following transcript(s): Z44808_PEA_1_T9 (SEQ ID NO:40). Table 355 below describes the starting and ending position of this segment on each transcript.

TABLE 355

Segment location on transcripts

| Transcript name | Segment starting position | Segment ending position |
|---|---|---|
| Z44808_PEA_1_T9 (SEQ ID NO:40) | 1974 | 2206 |

According to an optional embodiment of the present invention, short segments related to the above cluster are also provided. These segments are up to about 120 bp in length, and so are included in a separate description.

Segment cluster Z44808_PEA_1_node_11 (SEQ ID NO:1264) according to the present invention is supported by 25 libraries. The number of libraries was determined as previously described. This segment can be found in the following transcript(s): Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 356 below describes the starting and ending position of this segment on each transcript.

TABLE 356

Segment location on transcripts

| Transcript name | Segment starting position | Segment ending position |
|---|---|---|
| Z44808_PEA_1_T4 (SEQ ID NO:37) | 1097 | 1147 |
| Z44808_PEA_1_T5 (SEQ ID NO:38) | 1097 | 1147 |
| Z44808_PEA_1_T8 (SEQ ID NO:39) | 1097 | 1147 |
| Z44808_PEA_1_T9 (SEQ ID NO:40) | 1097 | 1147 |

Segment cluster Z44808_PEA_1_node_13 (SEQ ID NO:1265) according to the present invention is supported by 28 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 357 below describes the starting and ending position of this segment on each transcript.

TABLE 357

Segment location on transcripts

| Transcript name | Segment starting position | Segment ending position |
|---|---|---|
| Z44808_PEA_1_T11 (SEQ ID NO:36) | 1359 | 1441 |
| Z44808_PEA_1_T4 (SEQ ID NO:37) | 1410 | 1492 |
| Z44808_PEA_1_T5 (SEQ ID NO:38) | 1410 | 1492 |
| Z44808_PEA_1_T8 (SEQ ID NO:39) | 1410 | 1492 |
| Z44808_PEA_1_T9 (SEQ ID NO:40) | 1410 | 1492 |

Segment cluster Z44808_PEA_1_node_18 (SEQ ID NO:1266) according to the present invention is supported by 27 libraries. The number of libraries was determined as previously described. This segment can be found in the following transcript(s): Z44808_PEA_1_T11 (SEQ ID NO:36), Z44808_PEA_1_T4 (SEQ ID NO:37) Z44808_PEA_1_T5 (SEQ ID NO:38), Z44808_PEA_1_T8 (SEQ ID NO:39) and Z44808_PEA_1_T9 (SEQ ID NO:40). Table 358 below describes the starting and ending position of this segment on each transcript.

TABLE 358

Segment location on transcripts

| Transcript name | Segment starting position | Segment ending position |
|---|---|---|
| Z44808_PEA_1_T11 (SEQ ID NO:36) | 1359 | 1441 |
| Z44808_PEA_1_T4 (SEQ ID NO:37) | 1410 | 1492 |
| Z44808_PEA_1_T5 (SEQ ID NO:38) | 1410 | 1492 |
| Z44808_PEA_1_T8 (SEQ ID NO:39) | 1410 | 1492 |
| Z44808_PEA_1_T9 (SEQ ID NO:40) | 1410 | 1492 |

Segment cluster Z44808_PEA_1_node_22 (SEQ ID NO:1267) according to the present invention is supported by 33 libraries. The number of libraries was determined as previously described. This segment can be found in the following transcript(s): Z44808_PEA_1_T11 (SEQ ID NO:36), Z44808_PEA_1_T4 (SEQ ID NO:37) Z44808_PEA_1_T5 (SEQ ID NO:38), Z44808_PEA_1_T8 (SEQ ID NO:39) and Z44808_PEA_1_T9 (SEQ ID NO:40). Table 359 below describes the starting and ending position of this segment on each transcript.

TABLE 359

Segment location on transcripts

| Transcript name | Segment starting position | Segment ending position |
|---|---|---|
| Z44808_PEA_1_T11 (SEQ ID NO:36) | 1442 | 1544 |
| Z44808_PEA_1_T4 (SEQ ID NO:37) | 1493 | 1595 |
| Z44808_PEA_1_T5 (SEQ ID NO:38) | 1493 | 1595 |
| Z44808_PEA_1_T8 (SEQ ID NO:39) | 1493 | 1595 |
| Z44808_PEA_1_T9 (SEQ ID NO:40) | 1493 | 1595 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 360.

TABLE 360

Oligonucleotides related to this segment

| Oligonucleotide name | Overexpressed in cancers | Chip reference |
|---|---|---|
| Z44808_0_8_0 (SEQ ID NO:218) | Lung squamous cell carcinoma | LUN |

Segment cluster Z44808_PEA_1_node_26 (SEQ ID NO:1268) according to the present invention is supported by 2 libraries. The number of libraries was determined as previously described. This segment can be found in the following transcript(s): Z44808_PEA_1_T5 (SEQ ID NO:38). Table 361 below describes the starting and ending position of this segment on each transcript.

TABLE 361

Segment location on transcripts

| Transcript name | Segment starting position | Segment ending position |
|---|---|---|
| Z44808_PEA_1_T5 (SEQ ID NO:38) | 1871 | 1965 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to lung cancer), shown in Table 362.

TABLE 362

Oligonucleotides related to this segment

| Oligonucleotide name | Overexpressed in cancers | Chip reference |
|---|---|---|
| Z44808_0_0_72347 (SEQ ID NO:219) | Lung small cell cancer | LUN |

Segment cluster Z44808_PEA_1_node_30 (SEQ ID NO:1269) according to the present invention is supported by 44 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 363 below describes the starting and ending position of this segment on each transcript.

TABLE 363

Segment location on transcripts

| Transcript name | Segment starting position | Segment ending position |
|---|---|---|
| Z44808_PEA_1_T11 (SEQ ID NO:36) | 1820 | 1857 |
| Z44808_PEA_1_T4 (SEQ ID NO:37) | 1871 | 1908 |
| Z44808_PEA_1_T5 (SEQ ID NO:38) | 1966 | 2003 |
| Z44808_PEA_1_T8 (SEQ ID NO:39) | 1871 | 1908 |
| Z44808_PEA_1_T9 (SEQ ID NO:40) | 1871 | 1908 |

Segment cluster Z44808_PEA_1_node_34 (SEQ ID NO:1270) according to the present invention is supported by 70 libraries. The number of libraries was determined as previously described. This segment can be found in the following transcript(s): Z44808_PEA_1_T11 (SEQ ID NO:36), Z44808_PEA_1_T4 (SEQ ID NO:37) and Z44808_PEA_1_T5 (SEQ ID NO:38). Table 364 below describes the starting and ending position of this segment on each transcript.

TABLE 364

Segment location on transcripts

| Transcript name | Segment starting position | Segment ending position |
|---|---|---|
| Z44808_PEA_1_T11 (SEQ ID NO:36) | 2735 | 2809 |
| Z44808_PEA_1_T4 (SEQ ID NO:37) | 4471 | 4545 |
| Z44808_PEA_1_T5 (SEQ ID NO:38) | 2881 | 2955 |

Segment cluster Z44808_PEA_1_node_35 (SEQ ID NO:1271) according to the present invention can be found in the following transcript(s): Z44808_PEA_1_T11 (SEQ ID NO:36), Z44808 PEA_1_T4 (SEQ ID NO:37) and Z44808_PEA_1_T5 (SEQ ID NO:38). Table 365 below describes the starting and ending position of this segment on each transcript.

TABLE 365

Segment location on transcripts

| Transcript name | Segment starting position | Segment ending position |
|---|---|---|
| Z44808_PEA_1_T11 (SEQ ID NO:36) | 2810 | 2828 |
| Z44808_PEA_1_T4 (SEQ ID NO:37) | 4546 | 4564 |
| Z44808_PEA_1_T5 (SEQ ID NO:38) | 2956 | 2974 |

Segment cluster Z44808_PEA_1_node_39 (SEQ ID NO:1272) according to the present invention is supported by 1 libraries. The number of libraries was determined as previously described. This segment can be found in the following transcript(s): Z44808_PEA_1_T9 (SEQ ID NO:40). Table 366 below describes the starting and ending position of this segment on each transcript.

TABLE 366

Segment location on transcripts

| Transcript name | Segment starting position | Segment ending position |
|---|---|---|
| Z44808_PEA_1_T9 (SEQ ID NO:40) | 1909 | 1973 |

Segment cluster Z44808_PEA_1_node_4 (SEQ ID NO:1273) according to the present invention is supported by 33 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 367 below describes the starting and ending position of this segment on each transcript.

TABLE 367

Segment location on transcripts

| Transcript name | Segment starting position | Segment ending position |
|---|---|---|
| Z44808_PEA_1_T11 (SEQ ID NO:36) | 842 | 948 |
| Z44808_PEA_1_T4 (SEQ ID NO:37) | 842 | 948 |
| Z44808_PEA_1_T5 (SEQ ID NO:38) | 842 | 948 |
| Z44808_PEA_1_T8 (SEQ ID NO:39) | 842 | 948 |
| Z44808_PEA_1_T9 (SEQ ID NO:40) | 842 | 948 |

Segment cluster Z44808_PEA_1_node_6 (SEQ ID NO:1274) according to the present invention is supported by 30 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 368 below describes the starting and ending position of this segment on each transcript.

TABLE 368

Segment location on transcripts

| Transcript name | Segment starting position | Segment ending position |
|---|---|---|
| Z44808_PEA_1_T11 (SEQ ID NO:36) | 949 | 1048 |
| Z44808_PEA_1_T4 (SEQ ID NO:37) | 949 | 1048 |
| Z44808_PEA_1_T5 (SEQ ID NO:38) | 949 | 1048 |
| Z44808_PEA_1_T8 (SEQ ID NO:39) | 949 | 1048 |
| Z44808_PEA_1_T9 (SEQ ID NO:40) | 949 | 1048 |

Segment cluster Z44808_PEA_1_node_8 (SEQ ID NO:1275) according to the present invention is supported by 25 libraries. The number of libraries was determined as previously described. This segment can be found in the following transcript(s): Z44808_PEA_1_T11 (SEQ ID NO:36), Z44808_PEA_1_T4 (SEQ ID NO:37), Z44808_PEA_1_T5 (SEQ ID NO:38), Z44808_PEA_1_T8 (SEQ ID NO:39) and Z44808_PEA_1_T9 (SEQ ID NO:40). Table 369 below describes the starting and ending position of this segment on each transcript.

TABLE 369

Segment location on transcripts

| Transcript name | Segment starting position | Segment ending position |
|---|---|---|
| Z44808_PEA_1_T11 (SEQ ID NO:36) | 1049 | 1096 |
| Z44808_PEA_1_T4 (SEQ ID NO:37) | 1049 | 1096 |

TABLE 369-continued

Segment location on transcripts

| Transcript name | Segment starting position | Segment ending position |
|---|---|---|
| Z44808_PEA_1_T5 (SEQ ID NO:38) | 1049 | 1096 |
| Z44808_PEA_1_T8 (SEQ ID NO:39) | 1049 | 1096 |
| Z44808_PEA_1_T9 (SEQ ID NO:40) | 1049 | 1096 |

Variant protein alignment to the previously known protein:

Sequence name: /tmp/vUqLu6eAVZ/K3JDuPvaLo: SMO2_HUMAN (SEQ ID NO:1430)

Sequence documentation:

Alignment of: Z44808_PEA_1_P5 (SEQ ID NO:1314) x SMO2_HUMAN (SEQ ID NO:1430)

Alignment segment 1/1:

| | | | |
|---|---|---|---|
| Quality: | 4440.00 | Escore: | 0 |
| Matching length: | 441 | Total length: | 441 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSSGRLSEPDPSHTLEER 350
    ||||||||||||||||||||||||||||||||||||||||||||||||||
301 LQGCPGAKKHEFLTSVLDALSTDMVHAASDPSSSSGRLSEPDPSHTLEER 350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRHTPRGHAESTSNRQ         441
    |||||||||||||||||||||||||||||||||||||||||
401 DKSISVQELMGCLGVAKEDGKADTKKRHTPRGHAESTSNRQ         441
```

Sequence name: /tmp/QSUNfTsJ5y/kLOw5Vb6SD: SMO2_HUMAN (SEQ ID NO:1430)

Sequence documentation:

Alignment of: Z44808_PEA_1_P6 (SEQ ID NO:1315) x SMO2_HUMAN (SEQ ID NO:1430)

Alignment segment 1/1:

| | | | |
|---|---|---|---|
| Quality: | 4310.00 | Escore: | 0 |
| Matching length: | 428 | Total length: | 428 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSGRLSEPDPSHTLEER  350
    ||||||||||||||||||||||||||||||||||||||||||||||||||
301 LQGCPGAKKHEFLTSVLDALSTDMVHAASDPSSSGRLSEPDPSHTLEER  350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400

401 DKSISVQELMGCLGVAKEDGKADTKKRH                       428
    ||||||||||||||||||||||||||||
401 DKSISVQELMGCLGVAKEDGKADTKKRH                       428
```

Sequence name: /tmp/MZVdR4PVdM/5uN8RwViJ1: SMO2_HUMAN (SEQ ID NO:1430)
Sequence documentation:
Alignment of: Z44808_PEA_1_P7 (SEQ ID NO:1316) x SMO2_HUMAN (SEQ ID NO:1430)

Alignment segment 1/1:

| Quality: | 4440.00 | Escore: | 0 |
|---|---|---|---|
| Matching length: | 441 | Total length: | 441 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLLPQLCWLPLLAGLLPPVPAQKFSALTFLRVDQDKDKDCSLDCAGSPQK  50
    ||||||||||||||||||||||||||||||||||||||||||||||||||
  1 MLLPQLCWLPLLAGLLPPVPAQKFSALTFLRVDQDKDKDCSLDCAGSPQK  50

51 PLCASDGRTFLSRCEFQRAKCKDPQLEIAYRGNCKDVSRCVAERKYTQEQ 100
    ||||||||||||||||||||||||||||||||||||||||||||||||||
 51 PLCASDGRTFLSRCEFQRAKCKDPQLEIAYRGNCKDVSRCVAERKYTQEQ 100

101 ARKEFQQVFIPECNDDGTYSQVQCHSYTGYCWCVTPNGRPISGTAVAHKT 150
    ||||||||||||||||||||||||||||||||||||||||||||||||||
101 ARKEFQQVFIPECNDDGTYSQVQCHSYTGYCWCVTPNGRPISGTAVAHKT 150

151 PRCPGSVNEKLPQREGTGKTDDAAAPALETQPQGDEEDIASRYPTLWTEQ 200
    ||||||||||||||||||||||||||||||||||||||||||||||||||
151 PRCPGSVNEKLPQREGTGKTDDAAAPALETQPQGDEEDIASRYPTLWTEQ 200

201 VKSRQNKTNKNSVSSCDQEHQSALEEAKQPKNDNVVIPECAHGGLYKPVQ 250
    ||||||||||||||||||||||||||||||||||||||||||||||||||
201 VKSRQNKTNKNSVSSCDQEHQSALEEAKQPKNDNVVIPECAHGGLYKPVQ 250

251 CHPSTGYCWCVLVDTGRPIPGTSTRYEQPKCDNTARAHPAKARDLYKGRQ 300
    ||||||||||||||||||||||||||||||||||||||||||||||||||
251 CHPSTGYCWCVLVDTGRPIPGTSTRYEQPKCDNTARAHPAKARDLYKGRQ 300

301 LQGCPGAKKHEFLTSVLDALSTDMVHAASDPSSSGRLSEPDPSHTLEER  350
    ||||||||||||||||||||||||||||||||||||||||||||||||||
301 LQGCPGAKKHEFLTSVLDALSTDMVHAASDPSSSGRLSEPDPSHTLEER  350

351 VVHWYFKLLDKNSSGDIGKKEIKPFKRFLRKKSKPKKCVKKFVEYCDVNN 400
    ||||||||||||||||||||||||||||||||||||||||||||||||||
351 VVHWYFKLLDKNSSGDIGKKEIKPFKRFLRKKSKPKKCVKKFVEYCDVNN 400
```

```
401 DKSISVQELMGCLGVAKEDGKADTKKRHTPRGHAESTSNRQ     441
    ||||||||||||||||||||||||||||||||||||||||
401 DKSISVQELMGCLGVAKEDGKADTKKRHTPRGHAESTSNRQ     441
```

Sequence name: /tmp/3fGVxqLloe/J5mQduAdOF: SMO2_HUMAN (SEQ ID NO:1430)

Sequence documentation:

Alignment of: Z44808_PEA__1_P11 (SEQ ID NO:1317) x SMO2_HUMAN (SEQ ID NO:1430) . . .

Alignment segment 1/1:

| | |
|---|---|
| Quality: 4228.00 | Escore: 0 |
| Matching length: 429 | Total length: 446 |
| Matching Percent Similarity: 100.00 | Matching Percent Identity: 100.00 |
| Total Percent Similarity: 96.19 | Total Percent Identity: 96.19 |
| Gaps: 1 | |

Alignment:

Z44808junc8-11F (SEQ ID NO:1649) and Z44808junc8-11R (SEQ ID NO:1650) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99,

```
  1 MLLPQLCWLPLLAGLLPPVPAQKFSALTFLRVDQDKDKDCSLDCAGSPQK    50
    ||||||||||||||||||||||||||||||||||||||||||||||||||
  1 MLLPQLCWLPLLAGLLPPVPAQKFSALTFLRVDQDKDKDCSLDCAGSPQK    50

51 PLCASDGRTFLSRCEFQRAKCKDPQLEIAYRGNCKDVSRCVAERKYTQEQ   100
    |||||||||||||||||||||||||||||||||||||||||||||||||
 51 PLCASDGRTFLSRCEFQRAKCKDPQLEIAYRGNCKDVSRCVAERKYTQEQ   100

101 ARKEFQQVFIPECNDDGTYSQVQCHSYTGYCWCVTPNGRPISGTAVAHKT   150
    |||||||||||||||||||||||||||||||||||||||||||||||||
101 ARKEFQQVFIPECNDDGTYSQVQCHSYTGYCWCVTPNGRPISGTAVAHKT   150

151 PRCPGSVNEKLPQREGTGKT.................DIASRYPTLWTEQ   183
    ||||||||||||||||||||                 |||||||||||||
151 PRCPGSVNEKLPQREGTGKTDDAAAPALETQPQGDEEDIASRYPTLWTEQ   200

184 VKSRQNKTNKNSVSSCDQEHQSALEEAKQPKNDNVVIPECAHGGLYKPVQ   233
    |||||||||||||||||||||||||||||||||||||||||||||||||
201 VKSRQNKTNKNSVSSCDQEHQSALEEAKQPKNDNVVIPECAHGGLYKPVQ   250

234 CHPSTGYCWCVLVDTGRPIPGTSTRYEQPKCDNTARAHPAKARDLYKGRQ   283
    |||||||||||||||||||||||||||||||||||||||||||||||||
251 CHPSTGYCWCVLVDTGRPIPGTSTRYEQPKCDNTARAHPAKARDLYKGRQ   300

284 LQGCPGAKKHEFLTSVLDALSTDMVHAASDPSSSSGRLSEPDPSHTLEER   333
    |||||||||||||||||||||||||||||||||||||||||||||||||
301 LQGCPGAKKHEFLTSVLDALSTDMVHAASDPSSSSGRLSEPDPSHTLEER   350

334 VVHWYFKLLDKNSSGDIGKKEIKPFKRFLRKKSKPKKCVKKFVEYCDVNN   383
    |||||||||||||||||||||||||||||||||||||||||||||||||
351 VVHWYFKLLDKNSSGDIGKKEIKPFKRFLRKKSKPKKCVKKFVEYCDVNN   400

384 DKSISVQELMGCLGVAKEDGKADTKKRHTPRGHAESTSNRQPRKQG       429
    ||||||||||||||||||||||||||||||||||||||||||||||
401 DKSISVQELMGCLGVAKEDGKADTKKRHTPRGHAESTSNRQPRKQG       446
```

Expression of SMO2_HUMAN SPARC Related Modular Calcium-Binding Protein 2 Precursor Z44808 Transcripts which are Detectable by Amplicon as Depicted in Sequence Name Z44808junc8-11 (SEQ ID NO: 1651) in Normal and Cancerous Lung Tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to junc8-11, Z44808 junc8-11 amplicon (SEQ ID NO:1651) and Table 2, "Tissue samples in testing panel", above), to obtain a value of fold up-regulation for each sample relative to median of the normal PM samples.

Figure 29:
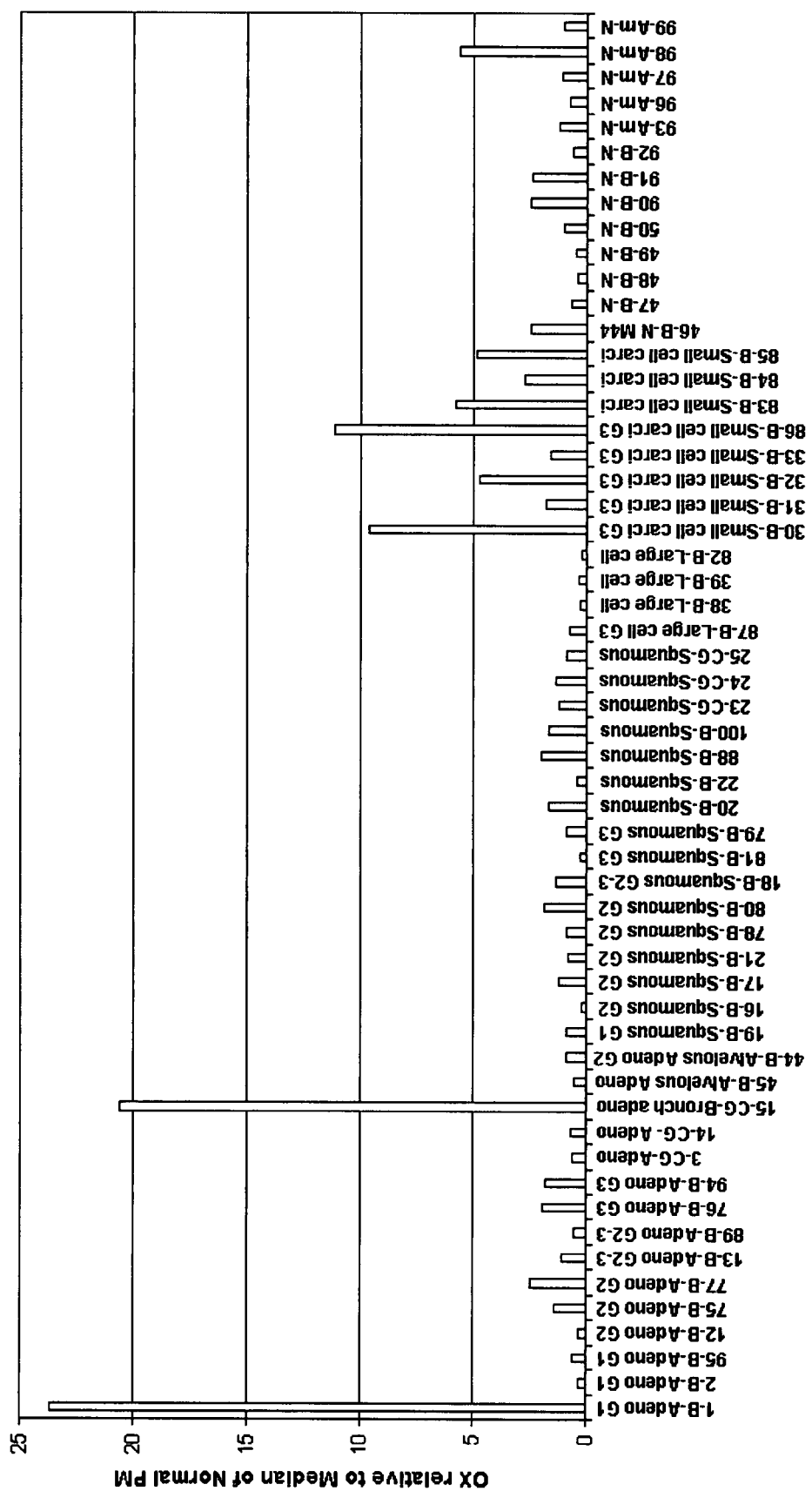
FIG. 29 is a histogram showing over expression of the SMO2_HUMAN SPARC related modular calcium-binding protein 2 Z44808 transcripts, which are detectable by amplicon as depicted in sequence name Z44808junc8-11 (SEQ ID NO:1651), in cancerous lung samples relative to the normal samples.

FIG. 29 is a histogram showing over expression of the above-indicated SMO2_HUMAN SPARC related modular calcium-binding protein 2 precursor transcripts in cancerous lung samples relative to the normal samples.

As is evident from FIG. 29, the expression of SMO2_HUMAN SPARC related modular calcium-binding protein 2 precursor transcripts detectable by the above amplicon in several cancer samples was significantly higher than in the non-cancerous samples (Sample Nos. 47-50, 90-93, 96-99 Table 2, "Tissue samples in testing panel"). Notably an over-expression of at least 5 fold was found in 2 out of 15 adenocarcinoma samples and in 3 out of 8 small cells carcinoma samples.

Primer pairs are also optionally and preferably encompassed within the present invention; for example, for the above experiment, the following primer pair was used as a non-limiting illustrative example only of a suitable primer pair: Z44808junc8-11F forward primer (SEQ ID NO:1649); and Z44808junc8-11R reverse primer (SEQ ID NO:1650).

The present invention also preferably encompasses any amplicon obtained through the use of any suitable primer pair; for example, for the above experiment, the following amplicon was obtained as a non-limiting illustrative example only of a suitable amplicon: Z44808junc8-11(SEQ ID NO:1651)

Forward primer (SEQ ID NO: 1649): GAAGGCACAG-GAAAAACAGATATTG

Reverse primer (SEQ ID NO: 1650): TGGTGCTCTTGGT-CACAGGAT

Amplicon (SEQ ID NO: 1651): GAAGGCACAG-GAAAAACAGATATTGCATCACGTTACCCTACCCTTT-GGACTGAACAGGTTAAAAGTC GGCAGAACAAAAC-CAATAAGAATTCAGTGTCATCCTGTGACCAAGAGC-ACCA Expression of SMO2_HUMAN SPARC Related Modular Calcium-Binding Protein 2 Precursor (Secreted Modular Calcium-Binding Protein 2) (SMOC-2) (Smooth Muscle-Associated Protein 2) Z44808 Transcripts Which are Detectable by Amplicon as Depicted in Sequence Name Z44808 junc8-11 (SEQ ID NO:1651) in Different Normal Tissues Expression of SMO2_HUMAN SPARC related modular calcium-binding protein 2 precursor (Secreted modular calcium-binding protein 2) (SMOC-2) (Smooth muscle-associated protein 2) transcripts detectable by or according to Z44808junc8-11 amplicon (SEQ ID NO:1651) and primers: Z44808junc8-11F (SEQ ID NO:1649) and Z44808junc8-11R (SEQ ID NO:1650) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Primers:

Forward primer (SEQ ID NO: 1649): GAAGGCACAG-GAAAAACAGATATTG

Reverse primer (SEQ ID NO: 1650): TGGTGCTCTTGGT-CACAGGAT

Figure 18:
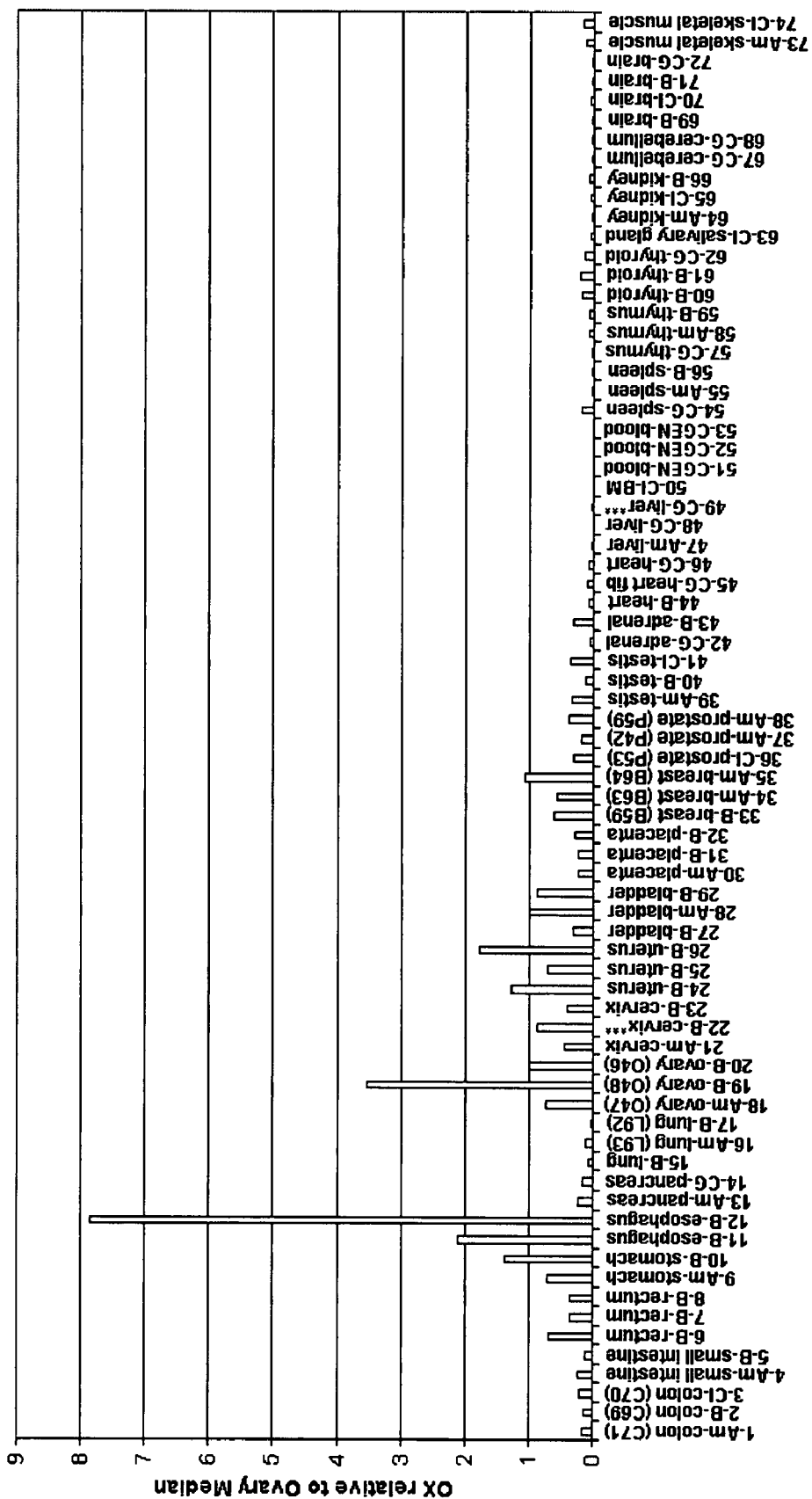
FIG. 18 is a histogram showing the expression of SMO2_HUMAN SPARC related modular calcium-binding protein 2 precursor (Secreted modular calcium-binding protein 2) (SMOC-2) (Smooth muscle-associated protein 2) Z44808 transcripts which are detectable by amplicon as depicted in sequence name Z44808 junc8-11 (SEQ ID NO:1651) in different normal tissues.

Amplicon (SEQ ID NO: 1651): GAAGGCACAG-GAAAAACAGATATTGCATCACGTTACCCTACCCTTT-GGACTGAACAGGTTAAAAGTC GGCAGAACAAAAC-CAATAAGAATTCAGTGTCATCCTGTGACCAAGAG-CACCA The results are demonstrated in FIG. 18, showing the expression of SMO2_HUMAN SPARC related modular calcium-binding protein 2 precursor (Secreted modular calcium-binding protein 2) (SMOC-2) (Smooth muscle-associated protein 2) Z44808 transcripts which are detectable by amplicon as depicted in sequence name Z44808 junc8-11 (SEQ ID NO:1651) in different normal tissues.

Description for Cluster AA161187

Cluster AA161187 features 7 transcript(s) and 20 segment(s) of interest, the names for which are given in Tables 370 and 371, respectively, the sequences themselves are given at the end of the application. The selected protein variants are given in table 372.

TABLE 370

Transcripts of interest

| Transcript Name | Sequence ID No. |
|---|---|
| AA161187_T0 | 41 |
| AA161187_T7 | 42 |
| AA161187_T15 | 43 |
| AA161187_T16 | 44 |
| AA161187_T20 | 45 |
| AA161187_T21 | 46 |
| AA161187_T22 | 47 |

TABLE 371

Segments of interest

| Segment Name | Sequence ID No. |
|---|---|
| AA161187_node_0 | 482 |
| AA161187_node_6 | 483 |
| AA161187_node_14 | 484 |
| AA161187_node_16 | 485 |
| AA161187_node_25 | 486 |
| AA161187_node_26 | 487 |
| AA161187_node_28 | 488 |
| AA161187_node_4 | 489 |
| AA161187_node_7 | 490 |
| AA161187_node_8 | 491 |
| AA161187_node_9 | 492 |
| AA161187_node_10 | 493 |
| AA161187_node_12 | 494 |
| AA161187_node_13 | 495 |
| AA161187_node_19 | 496 |
| AA161187_node_20 | 497 |
| AA161187_node_21 | 498 |
| AA161187_node_22 | 499 |
| AA161187_node_23 | 500 |
| AA161187_node_24 | 501 |

TABLE 372

Proteins of interest

| Protein Name | Sequence ID No. | Corresponding Transcript(s) |
|---|---|---|
| AA161187_P1 | 1318 | AA161187_T0 (SEQ ID NO:41) |
| AA161187_P6 | 1319 | AA161187_T7 (SEQ ID NO:42) |
| AA161187_P13 | 1320 | AA161187_T15 (SEQ ID NO:43) |
| AA161187_P14 | 1321 | AA161187_T16 (SEQ ID NO:44) |
| AA161187_P18 | 1322 | AA161187_T20 (SEQ ID NO:45) |
| AA161187_P19 | 1323 | AA161187_T21 (SEQ ID NO:46) |

These sequences are variants of the known protein Testisin precursor (SwissProt accession identifier TEST_HUMAN; known also according to the synonyms EC 3.4.21.-; Eosinophil serine protease 1; ESP-1; UNQ266/PRO303), SEQ ID NO: 1431, referred to herein as the previously known protein.

Protein Testisin precursor (SEQ ID NO:1431) is known or believed to have the following function(s): Could regulate proteolytic events associated with testicular germ cell maturation. The sequence for protein Testisin precursor is given at the end of the application, as "Testisin precursor amino acid sequence". Protein Testisin precursor localization is believed to be attached to the membrane by a GPI-anchor.

The following GO Annotation(s) apply to the previously known protein. The following annotation(s) were found: serine-type peptidase, which are annotation(s) related to Molecular Function; and membrane fraction; cytoplasm; plasma membrane, which are annotation(s) related to Cellular Component.

The GO assignment relies on information from one or more of the SwissProt/TremBl Protein knowledgebase, available from <dot expasy dot cb/sprot/>; or Locuslink, available from <dot ncbi dot nhm dot nih dot gov/projects/LocusLink/>.

Cluster AA161187 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 30 refer to weighted expression of ESTs in each category, as "parts per million" (ratio of the expression of ESTs for a particular cluster to the expression of all ESTs in that category, according to parts per million).

Figure 30:
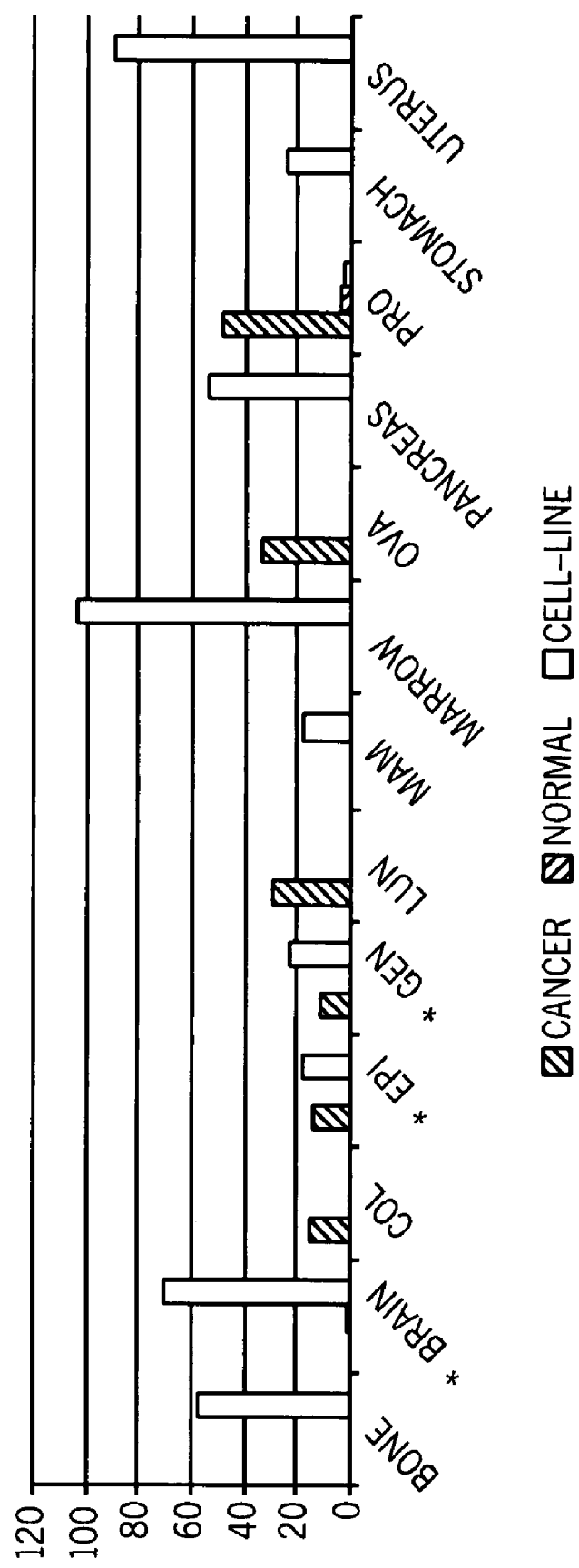
FIG. 30 is a histogram showing Cancer and cell-line vs. normal tissue expression for Cluster AA161187, demonstrating overexpression in brain malignant tumors, epithelial malignant tumors and a mixture of malignant tumors from different tissues.

Overall, the following results were obtained as shown with regard to the histograms in FIG. 30 and Table 373. This cluster is overexpressed (at least at a minimum level) in the following pathological conditions: brain malignant tumors, epithelial malignant tumors and a mixture of malignant tumors from different tissues.

TABLE 373

Normal tissue distribution

| Name of Tissue | Number |
|---|---|
| bone | 0 |
| brain | 1 |
| colon | 0 |
| epithelial | 0 |
| general | 0 |
| lung | 0 |
| breast | 0 |
| bone marrow | 0 |
| ovary | 0 |
| pancreas | 0 |
| prostate | 4 |
| stomach | 0 |
| uterus | 0 |

TABLE 374

P values and ratios for expression in cancerous tissue

| Name of Tissue | P1 | P2 | SP1 | R3 | SP2 | R4 |
|---|---|---|---|---|---|---|
| bone | 1 | 6.7e−01 | 1 | 1.0 | 3.4e−01 | 1.9 |
| brain | 9.8e−01 | 6.0e−01 | 1 | 0.7 | 3.8e−03 | 3.6 |
| colon | 4.4e−01 | 5.0e−01 | 7.0e−01 | 1.5 | 7.7e−01 | 1.3 |
| epithelial | 1.3e−02 | 2.6e−03 | 1.7e−03 | 8.4 | 2.4e−04 | 7.9 |
| general | 1.6e−03 | 1.9e−05 | 1.9e−05 | 12.1 | 2.9e−10 | 15.6 |

TABLE 374-continued

P values and ratios for expression in cancerous tissue

| Name of Tissue | P1 | P2 | SP1 | R3 | SP2 | R4 |
|---|---|---|---|---|---|---|
| lung | 5.0e−01 | 6.3e−01 | 1.7e−01 | 3.9 | 3.8e−01 | 2.2 |
| breast | 1 | 6.7e−01 | 1 | 1.0 | 8.2e−01 | 1.2 |
| bone marrow | 1 | 4.2e−01 | 1 | 1.0 | 1.5e−01 | 2.9 |
| ovary | 6.2e−01 | 6.5e−01 | 4.7e−01 | 1.9 | 5.9e−01 | 1.6 |
| pancreas | 1 | 4.4e−01 | 1 | 1.0 | 2.8e−01 | 2.8 |
| prostate | 5.9e−01 | 5.9e−01 | 1.4e−01 | 2.9 | 2.4e−01 | 2.3 |
| stomach | 1 | 4.7e−01 | 1 | 1.0 | 6.4e−01 | 1.5 |
| uterus | 1 | 2.4e−01 | 1 | 1.0 | 1.7e−01 | 2.0 |

As noted above, cluster AA161187 features 7 transcript(s), which were listed in Table 370 above. These transcript(s) encode for protein(s) which are variant(s) of protein Testisin precursor (SEQ ID NO:1431). A description of each variant protein according to the present invention is now provided.

Variant protein AA161187_P1 (SEQ ID NO:1318) according to the present invention has an amino acid sequence as given at the end of the application; it is encoded by transcript(s) AA161187 T0 (SEQ ID NO:41). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein AA161187_P1 (SEQ ID NO:1318) also has the following non-silent SNPs (Single Nucleotide Polymorphisms) as listed in Table 375, (given according to their position(s) on the amino acid sequence, with the alternative amino acid(s) listed; the last column indicates whether the SNP is known or not; the presence of known SNPs in variant protein AA161187_P1 (SEQ ID NO:1318) sequence provides support for the deduced sequence of this variant protein according to the present invention).

TABLE 375

Amino acid mutations

| SNP position(s) on amino acid sequence | Alternative amino acid(s) | Previously known SNP? |
|---|---|---|
| 1 | M –> | No |
| 16 | A –> | No |
| 226 | N –> | No |
| 253 | I –> V | No |
| 255 | V –> I | No |
| 264 | R –> | No |
| 264 | R –> P | No |
| 264 | R –> Q | Yes |

Variant protein AA161187_P1 (SEQ ID NO:1318) is encoded by the following transcript(s): AA161187_T0 (SEQ ID NO:41), for which the sequence(s) is/are given at the end of the application. The coding portion of transcript AA161187_T0 (SEQ ID NO:41) is shown in bold; this coding portion starts at position 107 and ends at position 1048. The transcript also has the following SNPs as listed in Table 376 (given according to their position on the nucleotide sequence, with the alternative nucleic acid listed; the last column indicates whether the SNP is known or not; the presence of known SNPs in variant protein AA161187_P1 (SEQ ID NO:1318) sequence provides support for the deduced sequence of this variant protein according to the present invention).

TABLE 376

Nucleic acid SNPs

| SNP position on nucleotide sequence | Alternative nucleic acid | Previously known SNP? |
|---|---|---|
| 66 | T –> A | No |
| 67 | T –> G | No |
| 105 | C –> T | No |
| 108 | T –> | No |
| 154 | T –> | No |
| 190 | C –> G | No |
| 469 | A –> G | Yes |
| 571 | C –> T | Yes |
| 782 | A –> | No |
| 859 | T –> C | Yes |
| 863 | A –> G | No |
| 869 | G –> A | No |
| 897 | G –> | No |
| 897 | G –> A | Yes |
| 897 | G –> C | No |
| 1000 | A –> G | Yes |
| 1068 | G –> | No |
| 1068 | G –> A | No |
| 1069 | C –> A | No |
| 1168 | A –> G | Yes |

Variant protein AA161187_P6 (SEQ ID NO:1319) according to the present invention has an amino acid sequence as given at the end of the application; it is encoded by transcript(s) AA161187_T7 (SEQ ID NO:42). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison report between AA161187_P6 (SEQ ID NO:1319) and TEST_HUMAN (SEQ ID NO:1431):

1. An isolated chimeric polypeptide encoding for AA161187 P6 (SEQ ID NO:1319), comprising a first amino acid sequence being at least 70%, optionally at least 80%, preferably at least 85%, more preferably at least 90% and most preferably at least 95% homologous to a polypeptide having the sequence HTREGTLGGQKRAFPDGVEG-EKGRGRAWGAASRGSAVPLTIR (SEQ ID NO: 273) corresponding to amino acids 1-42 of AA161187_P6 (SEQ ID NO:1319), and a second amino acid sequence being at least 90% homologous to GPCGRRVITSRIVGGEDAELGRWP-WQGSLRLWDSHVCGVSLLSHRWALTAAH-CFETYSDLSDPSGWMVQ FGQLTSMPSFWS-LQAYYTRYFVSNIYLSPRYLGNSPYDIALVKLSAPVT-YTKHIQPICLQASTFEFENRTDC WVTGWGY-IKEDEALPSPHTLQEVQVAIINNSMCNHLFLKYSF-RKDIFGDMVCAGNAQGGKDACFGDSGG PLAC-NKNGLWYQIGVVSWGVGCGRPNRPGVYT-NISHHFEWIQKLMAQSGMSQPDPSWPLLFFPLLWALP LLGPV corresponding to amino acids 31-314 of TEST_HUMAN (SEQ ID NO:1431), which also corresponds to amino acids 43-326 of AA161187_P6 (SEQ ID NO:1319), wherein said first amino acid sequence and second amino acid sequence are contiguous and in a sequential order.

2. An isolated polypeptide encoding for a head of AA161187_P6 (SEQ ID NO:1319), comprising a polypeptide being at least 70%, optionally at least about 80%, preferably at least about 85%, more preferably at least about 90% and most preferably at least about 95% homologous to the sequence HTREGTLGGQKRAFPDGVEGEKGRGRAW-GAASRGSAVPLTIR (SEQ ID NO: 273) of AA161187_P6 (SEQ ID NO:1319).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein AA161187_P6 (SEQ ID NO:1319) also has the following non-silent SNPs (Single Nucleotide Polymorphisms) as listed in Table 377, (given according to their position(s) on the amino acid sequence, with the alternative amino acid(s) listed; the last column indicates whether the SNP is known or not; the presence of known SNPs in variant protein AA161187_P6 (SEQ ID NO:1319) sequence provides support for the deduced sequence of this variant protein according to the present invention).

TABLE 377

Amino acid mutations

| SNP position(s) on amino acid sequence | Alternative amino acid(s) | Previously known SNP? |
|---|---|---|
| 238 | N –> | No |
| 265 | I –> V | No |
| 267 | V –> I | No |
| 276 | R –> | No |
| 276 | R –> P | No |
| 276 | R –> Q | Yes |

The glycosylation sites of variant protein AA161187_P6 (SEQ ID NO:1319), as compared to the known protein Testisin precursor (SEQ ID NO:1431), are described in Table 378 (given according to their position(s) on the amino acid sequence in the first column; the second column indicates whether the glycosylation site is present in the variant protein; and the last column indicates whether the position is different on the variant protein).

TABLE 378

Glycosylation site(s)

| Position(s) on known amino acid sequence | Present in variant protein? | Position in variant protein? |
|---|---|---|
| 200 | yes | 212 |
| 167 | yes | 179 |
| 273 | yes | 285 |

Variant protein AA161187_P6 (SEQ ID NO:1319) is encoded by the following transcript(s): AA161187_T7 (SEQ ID NO:42), for which the sequence(s) is/are given at the end of the application. The coding portion of transcript AA161187_T7 (SEQ ID NO:42) is shown in bold; this coding portion starts at position 1 and ends at position 979. The transcript also has the following SNPs as listed in Table 379 (given according to their position on the nucleotide sequence, with the alternative nucleic acid listed; the last column indicates whether the SNP is known or not; the presence of known SNPs in variant protein AA161187_P6 (SEQ ID NO:1319) sequence provides support for the deduced sequence of this variant protein according to the present invention).

TABLE 379

Nucleic acid SNPs

| SNP position on nucleotide sequence | Alternative nucleic acid | Previously known SNP? |
|---|---|---|
| 400 | A -> G | Yes |
| 502 | C -> T | Yes |
| 713 | A -> | No |
| 790 | T -> C | Yes |
| 794 | A -> G | No |
| 800 | G -> A | No |
| 828 | G -> | No |
| 828 | G -> A | Yes |
| 828 | G -> C | No |
| 931 | A -> G | Yes |
| 999 | G -> | No |
| 999 | G -> A | No |
| 1000 | C -> A | No |
| 1099 | A -> G | Yes |

Variant protein AA161187_P13 (SEQ ID NO:1320) according to the present invention has an amino acid sequence as given at the end of the application; it is encoded by transcript(s) AA161187_T15 (SEQ ID NO:43). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison report between AA161187_P13 (SEQ ID NO:1320) and TEST_HUMAN (SEQ ID NO:1431):

1. An isolated chimeric polypeptide encoding for AA161187_P13 (SEQ ID NO:1320), comprising a first amino acid sequence being at least 90% homologous to MGARGALLLALLLARAGLRKPESQEAA-PLSGPCGRRVITSRIVGGEDAELGRWP-WQGSLRLWDSHVCGV SLLSHRWALTAAHCFETYS-DLSDPSGWMVQFGQLTSMPSFWSLQAYYTRYFVSNI-YLSPRYLGNSPYDIA LVKLSAPVTYTKHIQPI-CLQASTFEFENRTDCWVTGWGYIKEDE corresponding to amino acids 1-183 of TEST_HUMAN (SEQ ID NO:1431), which also corresponds to amino acids 1-183 of AA161187_P13 (SEQ ID NO:1320), and a second amino acid sequence being at least 70%, optionally at least 80%, preferably at least 85%, more preferably at least 90% and most preferably at least 95% homologous to a polypeptide having the sequence GSSGRHHKQLYVQPPLPQVQF-PQGHLWRHG (SEQ ID NO: 274) corresponding to amino acids 184-213 of AA161187_P13 (SEQ ID NO:1320), wherein said first amino acid sequence and second amino acid sequence are contiguous and in a sequential order.

2. An isolated polypeptide encoding for a tail of AA161187_P13 (SEQ ID NO:1320), comprising a polypeptide being at least 70%, optionally at least about 80%, preferably at least about 85%, more preferably at least about 90% and most preferably at least about 95% homologous to the sequence GSSGRHHKQLYVQPPLPQVQFPQGHLWRHG (SEQ ID NO: 274) in AA161187_P13 (SEQ ID NO:1320).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P13 (SEQ ID NO:1320) also has the following non-silent SNPs (Single Nucleotide Polymorphisms) as listed in Table 380, (given according to their position(s) on the amino acid sequence, with the alternative amino acid(s) listed; the last column indicates whether the SNP is known or not; the presence of known SNPs in variant protein AA161187_P13 (SEQ ID NO:1320) sequence provides support for the deduced sequence of this variant protein according to the present invention).

TABLE 380

Amino acid mutations

| SNP position(s) on amino acid sequence | Alternative amino acid(s) | Previously known SNP? |
|---|---|---|
| 1 | M -> | No |
| 16 | A -> | No |

The glycosylation sites of variant protein AA161187_P13 (SEQ ID NO:1320), as compared to the known protein Testisin precursor (SEQ ID NO:1431), are described in Table 381 (given according to their position(s) on the amino acid sequence in the first column; the second column indicates whether the glycosylation site is present in the variant protein; and the last column indicates whether the position is different on the variant protein).

TABLE 381

Glycosylation site(s)

| Position(s) on known amino acid sequence | Present in variant protein? | Position in variant protein? |
|---|---|---|
| 200 | no | |
| 167 | yes | 167 |
| 273 | no | |

Variant protein AA161187_P13 (SEQ ID NO:1320) is encoded by the following transcript(s): AA161187_T15 (SEQ ID NO:43), for which the sequence(s) is/are given at the end of the application. The coding portion of transcript AA161187_T15 (SEQ ID NO:43) is shown in bold; this coding portion starts at position 107 and ends at position 745. The transcript also has the following SNPs as listed in Table 382 (given according to their position on the nucleotide sequence, with the alternative nucleic acid listed; the last column indicates whether the SNP is known or not; the presence of known SNPs in variant protein AA161187_P13 (SEQ ID NO:1320) sequence provides support for the deduced sequence of this variant protein according to the present invention).

TABLE 382

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |
| 190 | C -> G | No |

TABLE 382-continued

| Nucleic acid SNPs | | |
|---|---|---|
| SNP position on nucleotide sequence | Alternative nucleic acid | Previously known SNP? |
| 469 | A -> G | Yes |
| 571 | C -> T | Yes |
| 791 | T -> C | Yes |
| 795 | A -> G | No |
| 801 | G -> A | No |
| 829 | G -> | No |
| 829 | G -> A | Yes |
| 829 | G -> C | No |
| 932 | A -> G | Yes |
| 1000 | G -> | No |
| 1000 | G -> A | No |
| 1001 | C -> A | No |
| 1100 | A -> G | Yes |

Variant protein AA161187_P14 (SEQ ID NO:1321) according to the present invention has an amino acid sequence as given at the end of the application; it is encoded by transcript(s) AA161187_T16 (SEQ ID NO:44). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison report between AA161187_P14 (SEQ ID NO:1321) and TEST_HUMAN (SEQ ID NO:1431):

1. An isolated chimeric polypeptide encoding for AA161187_P14 (SEQ ID NO:1321), comprising a first amino acid sequence being at least 90% homologous to MGARGALLLALLLARAGLRKPESQEAA-PLSGPCGRRVITSRIVGGEDAELGRWP-WQGSLRLWDSHVCGV SLLSHRWALTAAHCFETYS-DLSDPSGWMVQFGQLTSMPSFWSLQAYYTRYFVSNI-YLSPRYLGNSPYDIA LVKLSAPVTYTKHIQPI-CLQASTFEFENRTDCWVTGWGYIKEDE corresponding to amino acids 1-183 of TEST_HUMAN (SEQ ID NO:1431), which also corresponds to amino acids 1-183 of AA161187_P14 (SEQ ID NO:1321), and a second amino acid sequence being at least 70%, optionally at least 80%, preferably at least 85%, more preferably at least 90% and most preferably at least 95% homologous to a polypeptide having the sequence GCCLSPSHYRPHSTAISPHPPGSS-GRHHKQLYVQPPLPQVQFPQGHLWRHGLCWQCP-RREGCLLRECPCH HSQPRKASCVPVPYLTLMPT-PGGGDCCPTLQMQKRRLGCCQGEEEDVHPVYPAP (SEQ ID NO: 275) corresponding to amino acids 184-307 of AA161187_P14 (SEQ ID NO:1321), wherein said first amino acid sequence and second amino acid sequence are contiguous and in a sequential order.

2. An isolated polypeptide encoding for a tail of AA161187_P14 (SEQ ID NO:1321), comprising a polypeptide being at least 70%, optionally at least about 80%, preferably at least about 85%, more preferably at least about 90% and most preferably at least about 95% homologous to the sequence GCCLSPSHYRPHSTAISPHPPGSSGRHH-KQLYVQPPLPQVQFPQGHLWRHGLCWQCPRREG-CLLRECPCH HSQPRKASCVPVPYLTLMPTPGGGDC-CPTLQMQKRRLGCCQGEEEDVHPVYPAP (SEQ ID NO: 275) in AA161187_P14 (SEQ ID NO:1321).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P14 (SEQ ID NO:1321) also has the following non-silent SNPs (Single Nucleotide Polymorphisms) as listed in Table 383, (given according to their position(s) on the amino acid sequence, with the alternative amino acid(s) listed; the last column indicates whether the SNP is known or not; the presence of known SNPs in variant protein AA161187_P14 (SEQ ID NO:1321) sequence provides support for the deduced sequence of this variant protein according to the present invention).

TABLE 383

| Amino acid mutations | | |
|---|---|---|
| SNP position(s) on amino acid sequence | Alternative amino acid(s) | Previously known SNP? |
| 1 | M -> | No |
| 16 | A -> | No |
| 238 | Q -> | No |

The glycosylation sites of variant protein AA161187_P14 (SEQ ID NO:1321), as compared to the known protein Testisin precursor (SEQ ID NO:1431), are described in Table 384 (given according to their position(s) on the amino acid sequence in the first column; the second column indicates whether the glycosylation site is present in the variant protein; and the last column indicates whether the position is different on the variant protein).

TABLE 384

| Glycosylation site(s) | | |
|---|---|---|
| Position(s) on known amino acid sequence | Present in variant protein? | Position in variant protein? |
| 200 | no | |
| 167 | yes | 167 |
| 273 | no | |

Variant protein AA161187_P14 (SEQ ID NO:1321) is encoded by the following transcript(s): AA161187_T16 (SEQ ID NO:44), for which the sequence(s) is/are given at the end of the application. The coding portion of transcript AA161187_T16 (SEQ ID NO:44) is shown in bold; this coding portion starts at position 107 and ends at position 1027. The transcript also has the following SNPs as listed in Table 385 (given according to their position on the nucleotide sequence, with the alternative nucleic acid listed; the last column indicates whether the SNP is known or not; the presence of known SNPs in variant protein AA161187_P14 (SEQ ID NO:1321) sequence provides support for the deduced sequence of this variant protein according to the present invention).

TABLE 385

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |
| 190 | C -> G | No |
| 469 | A -> G | Yes |
| 571 | C -> T | Yes |
| 819 | A -> | No |
| 859 | C -> T | Yes |
| 1152 | T -> C | Yes |
| 1156 | A -> G | No |
| 1162 | G -> A | No |
| 1190 | G -> | No |
| 1190 | G -> A | Yes |
| 1190 | G -> C | No |
| 1293 | A -> G | Yes |
| 1361 | G -> | No |
| 1361 | G -> A | No |
| 1362 | C -> A | No |
| 1461 | A -> G | Yes |

Variant protein AA161187_P18 (SEQ ID NO:1322) according to the present invention has an amino acid sequence as given at the end of the application; it is encoded by transcript(s) AA161187_T20 (SEQ ID NO:45). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison report between AA161187_P18 (SEQ ID NO:1322) and TEST_HUMAN (SEQ ID NO:1431):

1. An isolated chimeric polypeptide encoding for AA161187_P18 (SEQ ID NO:1322), comprising a first amino acid sequence being at least 70%, optionally at least 80%, preferably at least 85%, more preferably at least 90% and most preferably at least 95% homologous to a polypeptide having the sequence HTREGTLGGQKRAFPDGVEG-EKGRGRAWGAASRGSAVPLTIR (SEQ ID NO: 273) corresponding to amino acids 1-42 of AA161187_P18 (SEQ ID NO:1322), a second amino acid sequence being at least 90% homologous to GPCGRRVITSRIVGGEDAELGRWP-WQGSLRLWDSHVCGVSLLSHRWALTAAHCFET corresponding to amino acids 31-86 of TEST_HUMAN (SEQ ID NO:1431), which also corresponds to amino acids 43-98 of AA161187_P18 (SEQ ID NO:1322), a third amino acid sequence being at least 90% homologous to DLSDPSGWM-VQFGQLTSMPSFWSLQAYYTRYFVSNIYLSPRYLGN-SPYDIALVKLSAPVTYTKHIQPICLQ ASTFEFENRTD-CWVTGWGYIKEDEALPSPHTLQEVQVAIINNSMC-NHLFLKYSFRKDIFGDMVCAGNAQG GKDACF corresponding to amino acids 89-235 of TEST_HUMAN (SEQ ID NO:1431), which also corresponds to amino acids 99-245 of AA161187_P18 (SEQ ID NO:1322), and a fourth amino acid sequence being at least 70%, optionally at least 80%, preferably at least 85%, more preferably at least 90% and most preferably at least 95% homologous to a polypeptide having the sequence VSVPATTPSPGKHPVSLCLI (SEQ ID NO: 277) corresponding to amino acids 246-265 of AA161187_P18 (SEQ ID NO:1322), wherein said first amino acid sequence, second amino acid sequence, third amino acid sequence and fourth amino acid sequence are contiguous and in a sequential order.

2. An isolated polypeptide encoding for a head of AA161187_P18 (SEQ ID NO:1322), comprising a polypeptide being at least 70%, optionally at least about 80%, preferably at least about 85%, more preferably at least about 90% and most preferably at least about 95% homologous to the sequence HTREGTLGGQKRAFPDGVEGEKGRGRAW-GAASRGSAVPLTIR (SEQ ID NO: 273) of AA161187_P18 (SEQ ID NO:1322).

3. An isolated chimeric polypeptide encoding for an edge portion of AA161187_P18 (SEQ ID NO:1322), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise TD, having a structure as follows: a sequence starting from any of amino acid numbers 98-x 35 to 98; and ending at any of amino acid numbers 99+((n−2)−x), in which x varies from 0 to n−2.

4. An isolated polypeptide encoding for a tail of AA161187_P18 (SEQ ID NO:1322), comprising a polypeptide being at least 70%, optionally at least about 80%, preferably at least about 85%, more preferably at least about 90% and most preferably at least about 95% homologous to the sequence VSVPATTPSPGKHPVSLCLI (SEQ ID NO: 277) in AA161187_P18 (SEQ ID NO:1322).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein AA161187_P18 (SEQ ID NO:1322) also has the following non-silent SNPs (Single Nucleotide Polymorphisms) as listed in Table 386, (given according to their position(s) on the amino acid sequence, with the alternative amino acid(s) listed; the last column indicates whether the SNP is known or not; the presence of known SNPs in variant protein AA161187_P18 (SEQ ID NO:1322) sequence provides support for the deduced sequence of this variant protein according to the present invention).

TABLE 386

Amino acid mutations

| SNP position(s) on amino acid sequence | Alternative amino acid(s) | Previously known SNP? |
|---|---|---|
| 236 | N -> | No |
| 249 | P -> L | Yes |

The glycosylation sites of variant protein AA161187_P18 (SEQ ID NO:1322), as compared to the known protein Testisin precursor (SEQ ID NO:1431), are described in Table 387 (given according to their position(s) on the amino acid sequence in the first column; the second column indicates whether the glycosylation site is present in the variant protein; and the last column indicates whether the position is different on the variant protein).

TABLE 387

| Glycosylation site(s) | | |
|---|---|---|
| Position(s) on known amino acid sequence | Present in variant protein? | Position in variant protein? |
| 200 | yes | 210 |
| 167 | yes | 177 |
| 273 | no | |

Variant protein AA161187_P18 (SEQ ID NO:1322) is encoded by the following transcript(s): AA161187_T20 (SEQ ID NO:45), for which the sequence(s) is/are given at the end of the application. The coding portion of transcript AA161187_T20 (SEQ ID NO:45) is shown in bold; this coding portion starts at position 1 and ends at position 796. The transcript also has the following SNPs as listed in Table 388 (given according to their position on the nucleotide sequence, with the alternative nucleic acid listed; the last column indicates whether the SNP is known or not; the presence of known SNPs in variant protein AA161187_P18 (SEQ ID NO:1322) sequence provides support for the deduced sequence of this variant protein according to the present invention).

TABLE 388

| Nucleic acid SNPs | | |
|---|---|---|
| SNP position on nucleotide sequence | Alternative nucleic acid | Previously known SNP? |
| 394 | A -> G | Yes |
| 496 | C -> T | Yes |
| 707 | A -> | No |
| 747 | C -> T | Yes |
| 1040 | T -> C | Yes |
| 1044 | A -> G | No |
| 1050 | G -> A | No |
| 1078 | G -> | No |
| 1078 | G -> A | Yes |
| 1078 | G -> C | No |
| 1181 | A -> G | Yes |
| 1249 | G -> | No |
| 1249 | G -> A | No |
| 1250 | C -> A | No |
| 1349 | A -> G | Yes |

Variant protein AA161187_P19 (SEQ ID NO:1323) according to the present invention has an amino acid sequence as given at the end of the application; it is encoded by transcript(s) AA161187_T21 (SEQ ID NO:46). An alignment is given to the known protein (Testisin precursor (SEQ ID NO:1431)) at the end of the application. One or more alignments to one or more previously published protein sequences are given at the end of the application. A brief description of the relationship of the variant protein according to the present invention to each such aligned protein is as follows:

Comparison report between AA161187_P19 (SEQ ID NO:1323) and TEST_HUMAN (SEQ ID NO:1431):

1. An isolated chimeric polypeptide encoding for AA161187_P19 (SEQ ID NO:1323), comprising a first amino acid sequence being at least 90% homologous to MGARGALLLALLLARAGLRKPESQEAAPLSGPCGR-RVITSRIVGGEDAELGRWPWQGSLRLWDSHVCGV SLLSHRWALTAAHCFETYSDLSDPSGWMVQFGQLTS-MPSFWSLQAYYTRYFVSNIYLSPRYLGNSPYDIA LVKLSAPVTYTKHIQPICLQASTFEFENRTDCWVT-GWGYIKEDE corresponding to amino acids 1-183 of TEST_HUMAN (SEQ ID NO:1431), which also corresponds to amino acids 1-183 of AA161187_P19 (SEQ ID NO:1323), and a second amino acid sequence being at least 70%, optionally at least 80%, preferably at least 85%, more preferably at least 90% and most preferably at least 95% homologous to a polypeptide having the sequence DKRTQ (SEQ ID NO: 278) corresponding to amino acids 184-188 of AA161187_P19 (SEQ ID NO:1323), wherein said first amino acid sequence and second amino acid sequence are contiguous and in a sequential order.

2. An isolated polypeptide encoding for a tail of AA161187_P19 (SEQ ID NO:1323), comprising a polypeptide being at least 70%, optionally at least about 80%, preferably at least about 85%, more preferably at least about 90% and most preferably at least about 95% homologous to the sequence DKRTQ (SEQ ID NO: 278) in AA161187_P19 (SEQ ID NO:1323).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AA161187_P19 (SEQ ID NO:1323) also has the following non-silent SNPs (Single Nucleotide Polymorphisms) as listed in Table 389, (given according to their position(s) on the amino acid sequence, with the alternative amino acid(s) listed; the last column indicates whether the SNP is known or not; the presence of known SNPs in variant protein AA161187_P19 (SEQ ID NO:1323) sequence provides support for the deduced sequence of this variant protein according to the present invention).

TABLE 389

| Amino acid mutations | | |
|---|---|---|
| SNP position(s) on amino acid sequence | Alternative amino acid(s) | Previously known SNP? |
| 1 | M -> | No |
| 16 | A -> | No |

The glycosylation sites of variant protein AA161187_P19 (SEQ ID NO:1323), as compared to the known protein Testisin precursor (SEQ ID NO:1431), are described in Table 390 (given according to their position(s) on the amino acid sequence in the first column; the second column indicates whether the glycosylation site is present in the variant protein; and the last column indicates whether the position is different on the variant protein).

TABLE 390

| Glycosylation site(s) | | |
|---|---|---|
| Position(s) on known amino acid sequence | Present in variant protein? | Position in variant protein? |
| 200 | no | |
| 167 | yes | 167 |
| 273 | no | |

Variant protein AA161187_P19 (SEQ ID NO:1323) is encoded by the following transcript(s): AA161187_T21

(SEQ ID NO:46), for which the sequence(s) is/are given at the end of the application. The coding portion of transcript AA161187_T21 (SEQ ID NO:46) is shown in bold; this coding portion starts at position 107 and ends at position 670. The transcript also has the following SNPs as listed in Table 391 (given according to their position on the nucleotide sequence, with the alternative nucleic acid listed; the last column indicates whether the SNP is known or not; the presence of known SNPs in variant protein AA161187_P19 (SEQ ID NO:1323) sequence provides support for the deduced sequence of this variant protein according to the present invention).

TABLE 391

Nucleic acid SNPs

| SNP position on nucleotide sequence | Alternative nucleic acid | Previously known SNP? |
|---|---|---|
| 66 | T -> A | No |
| 67 | T -> G | No |
| 105 | C -> T | No |
| 108 | T -> | No |
| 154 | T -> | No |
| 190 | C -> G | No |
| 469 | A -> G | Yes |
| 571 | C -> T | Yes |
| 719 | G -> T | Yes |

As noted above, cluster AA161187 features 20 segment(s), which were listed in Table 371 above and for which the sequence(s) are given at the end of the application. These segment(s) are portions of nucleic acid sequence(s) which are described herein separately because they are of particular interest. A description of each segment according to the present invention is now provided.

Segment cluster AA161187_node_0 (SEQ ID NO:482) according to the present invention is supported by 21 libraries. The number of libraries was determined as previously described. This segment can be found in the following transcript(s): AA161187_T0 (SEQ ID NO:41), AA161187_T15 (SEQ ID NO:43), AA161187_T16 (SEQ ID NO:44), AA161187_T21 (SEQ ID NO:46) and AA161187_T22 (SEQ ID NO:47). Table 392 below describes the starting and ending position of this segment on each transcript.

TABLE 392

Segment location on transcripts

| Transcript name | Segment starting position | Segment ending position |
|---|---|---|
| AA161187_T0 (SEQ ID NO:41) | 1 | 170 |
| AA161187_T15 (SEQ ID NO:43) | 1 | 170 |
| AA161187_T16 (SEQ ID NO:44) | 1 | 170 |
| AA161187_T21 (SEQ ID NO:46) | 1 | 170 |
| AA161187_T22 (SEQ ID NO:47) | 1 | 170 |

Segment cluster AA161187_node_6 (SEQ ID NO:483) according to the present invention is supported by 3 libraries. The number of libraries was determined as previously described. This segment can be found in the following transcript(s): AA161187_T7 (SEQ ID NO:42) and AA161187_T20 (SEQ ID NO:45). Table 393 below describes the starting and ending position of this segment on each transcript.

TABLE 393

Segment location on transcripts

| Transcript name | Segment starting position | Segment ending position |
|---|---|---|
| AA161187_T7 (SEQ ID NO:42) | 1 | 120 |
| AA161187_T20 (SEQ ID NO:45) | 1 | 120 |

Segment cluster AA161187_node_14 (SEQ ID NO:484) according to the present invention is supported by 35 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 394 below describes the starting and ending position of this segment on each transcript.

TABLE 394

Segment location on transcripts

| Transcript name | Segment starting position | Segment ending position |
|---|---|---|
| AA161187_T0 (SEQ ID NO:41) | 446 | 656 |
| AA161187_T7 (SEQ ID NO:42) | 377 | 587 |
| AA161187_T15 (SEQ ID NO:43) | 446 | 656 |
| AA161187_T16 (SEQ ID NO:44) | 446 | 656 |
| AA161187_T20 (SEQ ID NO:45) | 371 | 581 |
| AA161187_T21 (SEQ ID NO:46) | 446 | 656 |
| AA161187_T22 (SEQ ID NO:47) | 446 | 656 |

Segment cluster AA161187_node_16 (SEQ ID NO:485) according to the present invention is supported by 2 libraries. The number of libraries was determined as previously described. This segment can be found in the following transcript(s): AA161187_T22 (SEQ ID NO:47). Table 395 below describes the starting and ending position of this segment on each transcript.

TABLE 395

Segment location on transcripts

| Transcript name | Segment starting position | Segment ending position |
|---|---|---|
| AA161187_T22 (SEQ ID NO:47) | 657 | 953 |

Segment cluster AA161187_node_25 (SEQ ID NO:486) according to the present invention is supported by 13 libraries. The number of libraries was determined as previously described. This segment can be found in the following transcript(s): AA161187_T16 (SEQ ID NO:44) and AA161187_T20 (SEQ ID NO:45). Table 396 below describes the starting and ending position of this segment on each transcript.

TABLE 396

Segment location on transcripts

| Transcript name | Segment starting position | Segment ending position |
|---|---|---|
| AA161187_T16 (SEQ ID NO:44) | 880 | 1104 |
| AA161187_T20 (SEQ ID NO:45) | 768 | 992 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 397.

TABLE 397

Oligonucleotides related to this segment

| Oligonucleotide name | Overexpressed in cancers | Chip reference |
|---|---|---|
| AA161187_0_0_430 (SEQ ID NO:222) | lung malignant tumors | LUN |

Segment cluster AA161187_node_26 (SEQ ID NO:487) according to the present invention is supported by 39 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 398 below describes the starting and ending position of this segment on each transcript.

TABLE 398

Segment location on transcripts

| Transcript name | Segment starting position | Segment ending position |
|---|---|---|
| AA161187_T0 (SEQ ID NO:41) | 812 | 1173 |
| AA161187_T7 (SEQ ID NO:42) | 743 | 1104 |
| AA161187_T15 (SEQ ID NO:43) | 744 | 1105 |
| AA161187_T16 (SEQ ID NO:44) | 1105 | 1466 |
| AA161187_T20 (SEQ ID NO:45) | 993 | 1354 |

Segment cluster AA161187_node_28 (SEQ ID NO:488) according to the present invention is supported by 4 libraries. The number of libraries was determined as previously described. This segment can be found in the following transcript(s): AA161187_T21 (SEQ ID NO:46). Table 399 below describes the starting and ending position of this segment on each transcript.

TABLE 399

Segment location on transcripts

| Transcript name | Segment starting position | Segment ending position |
|---|---|---|
| AA161187_T21 (SEQ ID NO:46) | 657 | 1171 |

According to an optional embodiment of the present invention, short segments related to the above cluster are also provided. These segments are up to about 120 bp in length, and so are included in a separate description.

Segment cluster AA161187_node_4 (SEQ ID NO:489) according to the present invention is supported by 22 libraries. The number of libraries was determined as previously described. This segment can be found in the following transcript(s): AA161187_T0 (SEQ ID NO:41), AA161187_T15 (SEQ ID NO:43), AA161187_T16 (SEQ ID NO:44), AA161187_T21 (SEQ ID NO:46) and AA161187_T22 (SEQ ID NO:47). Table 400 below describes the starting and ending position of this segment on each transcript.

TABLE 400

Segment location on transcripts

| Transcript name | Segment starting position | Segment ending position |
|---|---|---|
| AA161187_T0 (SEQ ID NO:41) | 171 | 197 |
| AA161187_T15 (SEQ ID NO:43) | 171 | 197 |
| AA161187_T16 (SEQ ID NO:44) | 171 | 197 |
| AA161187_T21 (SEQ ID NO:46) | 171 | 197 |
| AA161187_T22 (SEQ ID NO:47) | 171 | 197 |

Segment cluster AA161187_node_7 (SEQ ID NO:490) according to the present invention can be found in the following transcript(s): AA161187_T7 (SEQ ID NO:42) and AA161187_T20 (SEQ ID NO:45). Table 401 below describes the starting and ending position of this segment on each transcript.

TABLE 401

Segment location on transcripts

| Transcript name | Segment starting position | Segment ending position |
|---|---|---|
| AA161187_T7 (SEQ ID NO:42) | 121 | 128 |
| AA161187_T20 (SEQ ID NO:45) | 121 | 128 |

Segment cluster AA161187_node_8 (SEQ ID NO:491) according to the present invention is supported by 23 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 402 below describes the starting and ending position of this segment on each transcript.

TABLE 402

Segment location on transcripts

| Transcript name | Segment starting position | Segment ending position |
|---|---|---|
| AA161187_T0 (SEQ ID NO:41) | 198 | 256 |
| AA161187_T7 (SEQ ID NO:42) | 129 | 187 |
| AA161187_T15 (SEQ ID NO:43) | 198 | 256 |
| AA161187_T16 (SEQ ID NO:44) | 198 | 256 |
| AA161187_T20 (SEQ ID NO:45) | 129 | 187 |
| AA161187_T21 (SEQ ID NO:46) | 198 | 256 |
| AA161187_T22 (SEQ ID NO:47) | 198 | 256 |

Segment cluster AA161187_node_9 (SEQ ID NO:492) according to the present invention is supported by 24 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 403 below describes the starting and ending position of this segment on each transcript.

TABLE 403

Segment location on transcripts

| Transcript name | Segment starting position | Segment ending position |
|---|---|---|
| AA161187_T0 (SEQ ID NO:41) | 257 | 298 |
| AA161187_T7 (SEQ ID NO:42) | 188 | 229 |
| AA161187_T15 (SEQ ID NO:43) | 257 | 298 |
| AA161187_T16 (SEQ ID NO:44) | 257 | 298 |
| AA161187_T20 (SEQ ID NO:45) | 188 | 229 |
| AA161187_T21 (SEQ ID NO:46) | 257 | 298 |
| AA161187_T22 (SEQ ID NO:47) | 257 | 298 |

Segment cluster AA161187_node_10 (SEQ ID NO:493) according to the present invention is supported by 25 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 404 below describes the starting and ending position of this segment on each transcript.

TABLE 404

Segment location on transcripts

| Transcript name | Segment starting position | Segment ending position |
|---|---|---|
| AA161187_T0 (SEQ ID NO:41) | 299 | 363 |
| AA161187_T7 (SEQ ID NO:42) | 230 | 294 |
| AA161187_T15 (SEQ ID NO:43) | 299 | 363 |
| AA161187_T16 (SEQ ID NO:44) | 299 | 363 |
| AA161187_T20 (SEQ ID NO:45) | 230 | 294 |
| AA161187_T21 (SEQ ID NO:46) | 299 | 363 |
| AA161187_T22 (SEQ ID NO:47) | 299 | 363 |

Segment cluster AA161187_node_12 (SEQ ID NO:494) according to the present invention can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T21 (SEQ ID NO:46) and AA161187_T22 (SEQ ID NO:47). Table 405 below describes the starting and ending position of this segment on each transcript.

TABLE 405

Segment location on transcripts

| Transcript name | Segment starting position | Segment ending position |
|---|---|---|
| AA161187_T0 (SEQ ID NO:41) | 364 | 369 |
| AA161187_T7 (SEQ ID NO:42) | 295 | 300 |
| AA161187_T15 (SEQ ID NO:43) | 364 | 369 |
| AA161187_T16 (SEQ ID NO:44) | 364 | 369 |
| AA161187_T21 (SEQ ID NO:46) | 364 | 369 |
| AA161187_T22 (SEQ ID NO:47) | 364 | 369 |

Segment cluster AA161187_node_13 (SEQ ID NO:495) according to the present invention is supported by 25 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44), AA161187_T20 (SEQ ID NO:45), AA161187_T21 (SEQ ID NO:46) and AA161187_T22 (SEQ ID NO:47). Table 406 below describes the starting and ending position of this segment on each transcript.

TABLE 406

Segment location on transcripts

| Transcript name | Segment starting position | Segment ending position |
|---|---|---|
| AA161187_T0 (SEQ ID NO:41) | 370 | 445 |
| AA161187_T7 (SEQ ID NO:42) | 301 | 376 |
| AA161187_T15 (SEQ ID NO:43) | 370 | 445 |
| AA161187_T16 (SEQ ID NO:44) | 370 | 445 |
| AA161187_T20 (SEQ ID NO:45) | 295 | 370 |
| AA161187_T21 (SEQ ID NO:46) | 370 | 445 |
| AA161187_T22 (SEQ ID NO:47) | 370 | 445 |

Segment cluster AA161187_node_19 (SEQ ID NO:496) according to the present invention is supported by 4 libraries. The number of libraries was determined as previously described. This segment can be found in the following transcript(s): AA161187_T16 (SEQ ID NO:44). Table 407 below describes the starting and ending position of this segment on each transcript.

TABLE 407

Segment location on transcripts

| Transcript name | Segment starting position | Segment ending position |
|---|---|---|
| AA161187_T16 (SEQ ID NO:44) | 657 | 693 |

Segment cluster AA161187_node_20 (SEQ ID NO:497) according to the present invention is supported by 28 libraries. The number of libraries was determined as previously described. This segment can be found in the following transcript(s): AA161187_T0 (SEQ ID NO:41), AA161187_T7 (SEQ ID NO:42), AA161187_T16 (SEQ ID NO:44) and AA161187_T20 (SEQ ID NO:45). Table 408 below describes the starting and ending position of this segment on each transcript.

TABLE 408

Segment location on transcripts

| Transcript name | Segment starting position | Segment ending position |
|---|---|---|
| AA161187_T0 (SEQ ID NO:41) | 657 | 682 |
| AA161187_T7 (SEQ ID NO:42) | 588 | 613 |
| AA161187_T16 (SEQ ID NO:44) | 694 | 719 |
| AA161187_T20 (SEQ ID NO:45) | 582 | 607 |

Segment cluster AA161187_node_21 (SEQ ID NO:498) according to the present invention is supported by 31 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 409 below describes the starting and ending position of this segment on each transcript.

TABLE 409

Segment location on transcripts

| Transcript name | Segment starting position | Segment ending position |
|---|---|---|
| AA161187_T0 (SEQ ID NO:41) | 683 | 741 |
| AA161187_T7 (SEQ ID NO:42) | 614 | 672 |
| AA161187_T15 (SEQ ID NO:43) | 657 | 715 |
| AA161187_T16 (SEQ ID NO:44) | 720 | 778 |
| AA161187_T20 (SEQ ID NO:45) | 608 | 666 |

Segment cluster AA161187_node__22 (SEQ ID NO:499) according to the present invention is supported by 34 libraries. The number of libraries was determined as previously described. This segment can be found in the following transcript(s): AA161187_T0 (SEQ ID NO:41), AA161187_T7 (SEQ ID NO:42), AA161187_T15 (SEQ ID NO:43), AA161187_T16 (SEQ ID NO:44) and AA161187_T20 (SEQ ID NO:45). Table 410 below describes the starting and ending position of this segment on each transcript.

TABLE 410

Segment location on transcripts

| Transcript name | Segment starting position | Segment ending position |
|---|---|---|
| AA161187_T0 (SEQ ID NO:41) | 742 | 769 |
| AA161187_T7 (SEQ ID NO:42) | 673 | 700 |
| AA161187_T15 (SEQ ID NO:43) | 716 | 743 |
| AA161187_T16 (SEQ ID NO:44) | 779 | 806 |
| AA161187_T20 (SEQ ID NO:45) | 667 | 694 |

Segment cluster AA161187_node__23 (SEQ ID NO:500) according to the present invention is supported by 31 libraries. The number of libraries was determined as previously described. This segment can be found in the following transcript(s): AA161187_T0 (SEQ ID NO:41), AA161187_T7 (SEQ ID NO:42), AA161187_T16 (SEQ ID NO:44) and AA161187_T20 (SEQ ID NO:45). Table 411 below describes the starting and ending position of this segment on each transcript.

TABLE 411

Segment location on transcripts

| Transcript name | Segment starting position | Segment ending position |
|---|---|---|
| AA161187_T0 (SEQ ID NO:41) | 770 | 811 |
| AA161187_T7 (SEQ ID NO:42) | 701 | 742 |
| AA161187_T16 (SEQ ID NO:44) | 807 | 848 |
| AA161187_T20 (SEQ ID NO:45) | 695 | 736 |

Segment cluster AA161187_node__24 (SEQ ID NO:501) according to the present invention is supported by 12 libraries. The number of libraries was determined as previously described. This segment can be found in the following transcript(s): AA161187_T16 (SEQ ID NO:44) and AA161187 T20 (SEQ ID NO:45). Table 412 below describes the starting and ending position of this segment on each transcript.

TABLE 412

Segment location on transcripts

| Transcript name | Segment starting position | Segment ending position |
|---|---|---|
| AA161187_T16 (SEQ ID NO:44) | 849 | 879 |
| AA161187_T20 (SEQ ID NO:45) | 737 | 767 |

Variant protein alignment to the previously known protein:

Sequence name: TEST_HUMAN (SEQ ID NO:1431)

Sequence documentation:

Alignment of: AA161187_P6 (SEQ ID NO:1319) x TEST_HUMAN (SEQ ID NO:1431)

Alignment segment 1/1:

| | |
|---|---|
| Quality: 2894.00 | Escore: 0 |
| Matching length: 284 | Total length: 284 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 43 GPCGRRVITSRIVGGEDAELGRWPWQGSLRLWDSHVCGVSLLSHRWALTA  92
    ||||||||||||||||||||||||||||||||||||||||||||||||||
 31 GPCGRRVITSRIVGGEDAELGRWPWQGSLRLWDSHVCGVSLLSHRWALTA  80

93 AHCFETYSDLSDPSGWMVQFGQLTSMPSFWSLQAYYTRYFVSNIYLSPRY 142
    ||||||||||||||||||||||||||||||||||||||||||||||||||
 81 AHCFETYSDLSDPSGWMVQFGQLTSMPSFWSLQAYYTRYFVSNIYLSPRY 130

143 LGNSPYDIALVKLSAPVTYTKHIQPICLQASTFEFENRTDCWVTGWGYIK 192
    ||||||||||||||||||||||||||||||||||||||||||||||||||
131 LGNSPYDIALVKLSAPVTYTKHIQPICLQASTFEFENRTDCWVTGWGYIK 180
```

```
193 EDEALPSPHTLQEVQVAIINNSMCNHLFLKYSFRKDIFGDMVCAGNAQGG 242
    |||||||||||||||||||||||||||||||||||||||||||||||||
181 EDEALPSPHTLQEVQVAIINNSMCNHLFLKYSFRKDIFGDMVCAGNAQGG 230

243 KDACFGDSGGPLACNKNGLWYQIGVVSWGVGCGRPNRPGVYTNISHHFEW 292
    |||||||||||||||||||||||||||||||||||||||||||||||||
231 KDACFGDSGGPLACNKNGLWYQIGVVSWGVGCGRPNRPGVYTNISHHFEW 280

293 IQKLMAQSGMSQPDPSWPLLFFPLLWALPLLGPV              326
    |||||||||||||||||||||||||||||||||
281 IQKLMAQSGMSQPDPSWPLLFFPLLWALPLLGPV              314
```

Sequence name: TEST_HUMAN (SEQ ID NO:1431)

Sequence documentation:

Alignment of: AA161187_P13 (SEQ ID NO:1320) x TEST_HUMAN (SEQ ID NO:1431)

Alignment segment 1/1:

| | |
|---|---|
| Quality: 1829.00 | Escore: 0 |
| Matching length: 183 | Total length: 183 |
| Matching Percent Similarity: 100.00 | Matching Percent Identity: 100.00 |
| Total Percent Similarity: 100.00 | Total Percent Identity: 100.00 |
| Gaps: 0 | |

Sequence name: TEST_HUMAN (SEQ ID NO:1431)

Sequence documentation:

Alignment of: AA161187_P14 (SEQ ID NO:1321) x TEST_HUMAN (SEQ ID NO:1431)

Alignment segment 1/1:

| | | | |
|---|---|---|---|
| Quality: | 1829.00 | Escore: | 0 |
| Matching length: | 183 | Total length: | 183 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGARGALLLALLLARAGLRKPESQEAAPLSGPCGRRVITSRIVGGEDAEL  50
    |||||||||||||||||||||||||||||||||||||||||||||||||
  1 MGARGALLLALLLARAGLRKPESQEAAPLSGPCGRRVITSRIVGGEDAEL  50

51 GRWPWQGSLRLWDSHVCGVSLLSHRWALTAAHCFETYSDLSDPSGWMVQF 100
    |||||||||||||||||||||||||||||||||||||||||||||||||
 51 GRWPWQGSLRLWDSHVCGVSLLSHRWALTAAHCFETYSDLSDPSGWMVQF 100

101 GQLTSMPSFWSLQAYYTRYFVSNIYLSPRYLGNSPYDIALVKLSAPVTYT 150
    |||||||||||||||||||||||||||||||||||||||||||||||||
101 GQLTSMPSFWSLQAYYTRYFVSNIYLSPRYLGNSPYDIALVKLSAPVTYT 150

151 KHIQPICLQASTFEFENRTDCWVTGWGYIKEDE                 183
    ||||||||||||||||||||||||||||||||
151 KHIQPICLQASTFEFENRTDCWVTGWGYIKEDE                 183
```

Alignment:

```
  1 MGARGALLLALLLARAGLRKPESQEAAPLSGPCGRRVITSRIVGGEDAEL  50
    |||||||||||||||||||||||||||||||||||||||||||||||||
  1 MGARGALLLALLLARAGLRKPESQEAAPLSGPCGRRVITSRIVGGEDAEL  50

51 GRWPWQGSLRLWDSHVCGVSLLSHRWALTAAHCFETYSDLSDPSGWMVQF 100
    |||||||||||||||||||||||||||||||||||||||||||||||||
 51 GRWPWQGSLRLWDSHVCGVSLLSHRWALTAAHCFETYSDLSDPSGWMVQF 100

101 GQLTSMPSFWSLQAYYTRYFVSNIYLSPRYLGNSPYDIALVKLSAPVTYT 150
    |||||||||||||||||||||||||||||||||||||||||||||||||
101 GQLTSMPSFWSLQAYYTRYFVSNIYLSPRYLGNSPYDIALVKLSAPVTYT 150

151 KHIQPICLQASTFEFENRTDCWVTGWGYIKEDE                 183
    ||||||||||||||||||||||||||||||||
151 KHIQPICLQASTFEFENRTDCWVTGWGYIKEDE                 183
```

Sequence name: TEST_HUMAN (SEQ ID NO:1431)

Sequence documentation:

Alignment of: AA161187_P18 (SEQ ID NO:1322) x TEST_HUMAN (SEQ ID NO:1431)

Alignment segment 1/1:

| Quality: | 1957.00 | Escore: | 0 |
|---|---|---|---|
| Matching length: | 203 | Total length: | 205 |
| Matching Percent Similarity: | 100.00 | Matching Percent Identity: | 100.00 |
| Total Percent Similarity: | 99.02 | Total Percent Identity: | 99.02 |
| Gaps: | 1 | | |

Alignment:

```
 43 GPCGRRVITSRIVGGEDAELGRWPWQGSLRLWDSHVCGVSLLSHRWALTA  92
    |||||||||||||||||||||||||||||||||||||||||||||||||
 31 GPCGRRVITSRIVGGEDAELGRWPWQGSLRLWDSHVCGVSLLSHRWALTA  80

93 AHCFET..DLSDPSGWMVQFGQLTSMPSFWSLQAYYTRYFVSNIYLSPRY 140
    ||||||  |||||||||||||||||||||||||||||||||||||||||
 81 AHCFETYSDLSDPSGWMVQFGQLTSMPSFWSLQAYYTRYFVSNIYLSPRY 130

141 LGNSPYDIALVKLSAPVTYTKHIQPICLQASTFEFENRTDCWVTGWGYIK 190
    |||||||||||||||||||||||||||||||||||||||||||||||||
131 LGNSPYDIALVKLSAPVTYTKHIQPICLQASTFEFENRTDCWVTGWGYIK 180

191 EDEALPSPHTLQEVQVAIINNSMCNHLFLKYSFRKDIFGDMVCAGNAQGG 240
    |||||||||||||||||||||||||||||||||||||||||||||||||
181 EDEALPSPHTLQEVQVAIINNSMCNHLFLKYSFRKDIFGDMVCAGNAQGG 230

241 KDACF                                             245
    |||||
231 KDACF                                             235
```

Sequence name: TEST_HUMAN (SEQ ID NO:1431)

Sequence documentation:

Alignment of: AA161187_P19 (SEQ ID NO:1323) x TEST_HUMAN (SEQ ID NO:1431)

Alignment segment 1/1:

| Quality: | 1829.00 | Escore: | 0 |
|---|---|---|---|
| Matching length: | 183 | Total length: | 183 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGARGALLLALLLARAGLRKPESQEAAPLSGPCGRRVITSRIVGGEDAEL  50
    |||||||||||||||||||||||||||||||||||||||||||||||||
  1 MGARGALLLALLLARAGLRKPESQEAAPLSGPCGRRVITSRIVGGEDAEL  50

51 GRWPWQGSLRLWDSHVCGVSLLSHRWALTAAHCFETYSDLSDPSGWMVQF 100
    |||||||||||||||||||||||||||||||||||||||||||||||||
 51 GRWPWQGSLRLWDSHVCGVSLLSHRWALTAAHCFETYSDLSDPSGWMVQF 100

101 GQLTSMPSFWSLQAYYTRYFVSNIYLSPRYLGNSPYDIALVKLSAPVTYT 150
    |||||||||||||||||||||||||||||||||||||||||||||||||
101 GQLTSMPSFWSLQAYYTRYFVSNIYLSPRYLGNSPYDIALVKLSAPVTYT 150

151 KHIQPICLQASTFEFENRTDCWVTGWGYIKEDE                 183
    |||||||||||||||||||||||||||||||||
151 KHIQPICLQASTFEFENRTDCWVTGWGYIKEDE                 183
```

Expression of *Homo Sapiens* Protease, Serine, 21 (Testisin) (PRSS21) AA161187 Transcripts which are Detectable by Amplicon as Depicted in Sequence Name AA161187 seg25 (SEQ ID NO:1654) in Normal and Cancerous Lung Tissues Expression of *Homo sapiens* protease, serine, 21 (testisin) (PRSS21) transcripts detectable by or according to seg25, AA161187 seg25 amplicon (SEQ ID NO:1654) and primers AA161187 seg17F2 (SEQ ID NO:1652) and AA161187 seg17R2 (SEQ ID NO:1653) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal postmortem (PM) samples (Sample Nos. 47-50, 90-93, 96-99, Table 2, above), to obtain a value of fold up-regulation for each sample relative to median of the normal PM samples.

Figure 64:
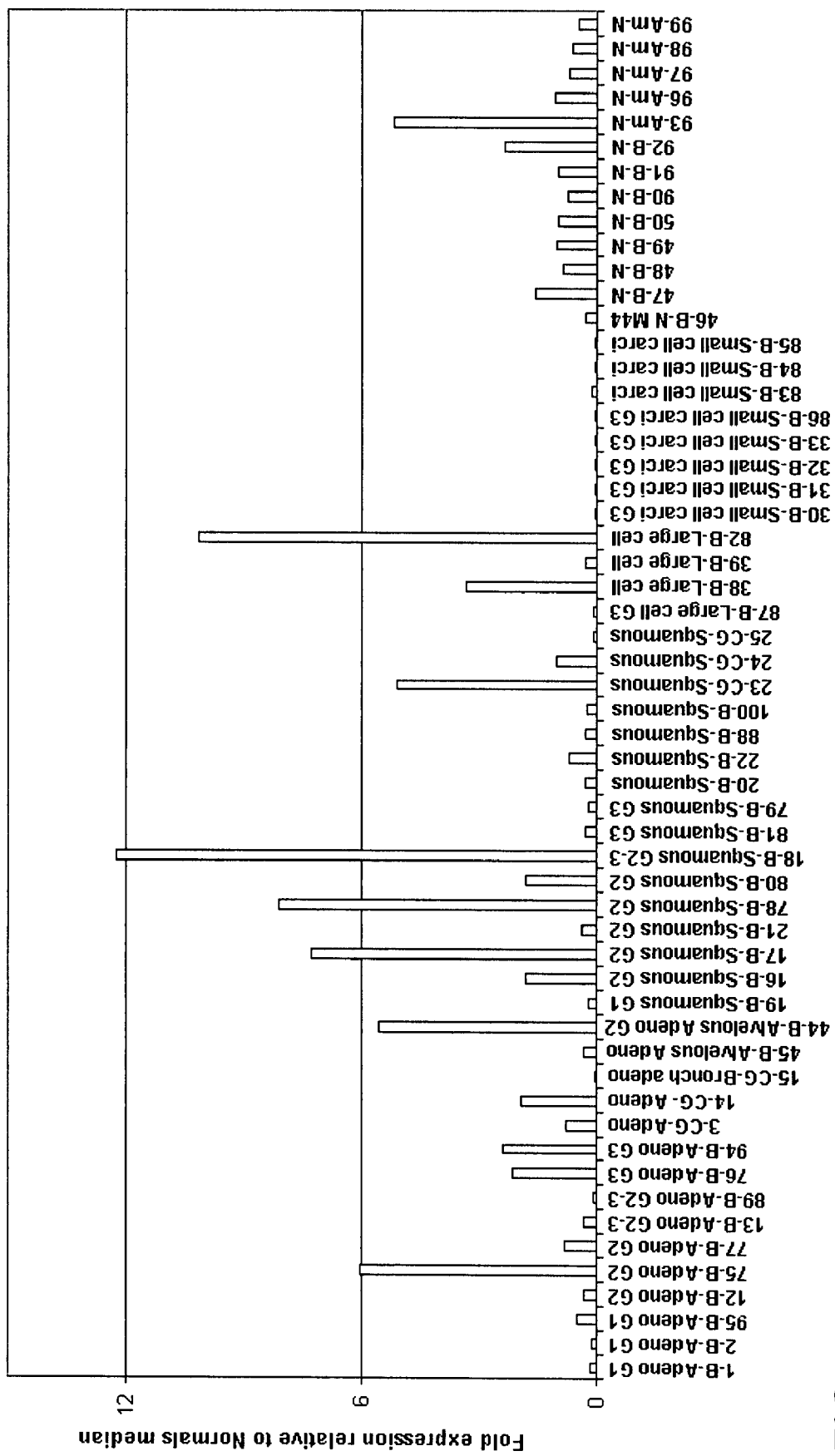
FIG. 64 is a histogram showing over expression of the Homo sapiens protease, serine, 21 (testisin) (PRSS21) AA161187 transcripts, which are detectable by amplicon as depicted in sequence name AA161187 seg25 (SEQ ID NO:1654), in cancerous lung samples relative to the normal samples.

FIG. 64 is a histogram showing over expression of the above-indicated *Homo sapiens* protease, serine, 21 (testisin) (PRSS21) transcripts in cancerous lung samples relative to the normal samples.

As is evident from FIG. 64, the expression of *Homo sapiens* protease, serine, 21 (testisin) (PRSS21) transcripts detectable by the above amplicon(s) was higher in a few cancer samples than in the non-cancerous samples (Sample Nos. 46-50, 90-93, 96-99 Table 2). Notably an over-expression of at least 6 fold was found in 1 out of 15 adenocarcinoma samples, 3 out of 16 squamous cell carcinoma samples, 1 out of 4 large cell carcinoma samples.

Primer pairs are also optionally and preferably encompassed within the present invention; for example, for the above experiment, the following primer pair was used as a non-limiting illustrative example only of a suitable primer pair: AA161187 seg17F2 forward primer (SEQ ID NO:1652); and AA161187 seg17R2 reverse primer (SEQ ID NO:1653).

The present invention also preferably encompasses any amplicon obtained through the use of any suitable primer pair; for example, for the above experiment, the following amplicon was obtained as a non-limiting illustrative example only of a suitable amplicon: AA161187 seg25 (SEQ ID NO:1654).

Forward primer AA161187 seg17F2 (SEQ ID NO:1652): CCCTGTGCCTTATTTGACCCT

Reverse primer AA161187 seg17R2 (SEQ ID NO:1653): GCTGGGTAGACTGGGTGCA

Amplicon AA161187 seg25 (SEQ ID NO:1654): CCTGTGCCTTATTTGACCCTCATGCCAAC-CCCGGGAGGTGGAGACTGTTGC-CCCACTCTGCAGATGCA GAAACGGAGGCTTGGCTGCTGCCAGGGGGAGGA Description for Cluster R66178

Cluster R66178 features 3 transcript(s) and 16 segment(s) of interest, the names for which are given in Tables 413 and 414, respectively, the sequences themselves are given at the end of the application. The selected protein variants are given in table 415.

TABLE 413

Transcripts of interest

| Transcript Name | Sequence ID No. |
| --- | --- |
| R66178_T2 | 48 |
| R66178_T3 | 49 |
| R66178_T7 | 50 |

TABLE 414

Segments of interest

| Segment Name | Sequence ID No. |
| --- | --- |
| R66178_node_0 | 502 |
| R66178_node_6 | 503 |
| R66178_node_8 | 504 |
| R66178_node_15 | 505 |
| R66178_node_24 | 506 |
| R66178_node_26 | 507 |
| R66178_node_27 | 508 |
| R66178_node_4 | 509 |
| R66178_node_5 | 510 |
| R66178_node_9 | 511 |
| R66178_node_11 | 512 |
| R66178_node_16 | 513 |
| R66178_node_18 | 514 |
| R66178_node_19 | 515 |
| R66178_node_20 | 516 |
| R66178_node_21 | 517 |

TABLE 415

Proteins of interest

| Protein Name | Sequence ID No. | Corresponding Transcript(s) |
| --- | --- | --- |
| R66178_P3 | 1324 | R66178_T2 (SEQ ID NO:48) |
| R66178_P4 | 1325 | R66178_T3 (SEQ ID NO:49) |
| R66178_P8 | 1326 | R66178_T7 (SEQ ID NO:50) |

These sequences are variants of the known protein Poliovirus receptor related protein 1 precursor (SwissProt accession identifier PVR1_HUMAN; known also according to the synonyms Herpes virus entry mediator C; HveC; Nectin 1; Herpesvirus Ig-like receptor; HIgR; CD111 antigen), SEQ ID NO:1432, referred to herein as the previously known protein.

Protein Poliovirus receptor related protein 1 precursor (SEQ ID NO:1432) is known or believed to have the following function(s): probably involved in cell adhesion; receptor for alphaherpesvirus (HSV-1, HSV-2 and Pseudorabies virus) entry into cells. The sequence for protein Poliovirus receptor related protein 1 precursor is given at the end of the application, as "Poliovirus receptor related protein 1 precursor amino acid sequence". Protein Poliovirus receptor related protein 1 precursor localization is believed to be Type I membrane protein (isoforms alpha and delta). Secreted (isoform gamma).

The following GO Annotation(s) apply to the previously known protein. The following annotation(s) were found: immune response; cell-cell adhesion, which are annotation(s) related to Biological Process; cell adhesion receptor; protein binding; coreceptor, which are annotation(s) related to Molecular Function; and adherens junction; integral membrane protein, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster R66178 features 3 transcript(s), which were listed in Table 413 above. These transcript(s) encode for protein(s) which are variant(s) of protein Poliovirus receptor related protein 1 precursor (SEQ ID NO:1432). A description of each variant protein according to the present invention is now provided.

Variant protein R66178_P3 (SEQ ID NO:1324) according to the present invention has an amino acid sequence as given at the end of the application; it is encoded by transcript(s) R66178T2 (SEQ ID NO:48). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison report between R66178_P3 (SEQ ID NO:1324) and PVR1_HUMAN (SEQ ID NO:1432):

1. An isolated chimeric polypeptide encoding for R66178_P3 (SEQ ID NO:1324), comprising a first amino acid sequence being at least 90% homologous to MARMGLAGAAGRWWGLALGLTAFFLPGVHSQVV-QVNDSMYGFIGTDVVLHCSFANPLPSVKITQVTWQ KSTNGSKQNVAIYNPSMGVSVLAPYRERVEFLRPS-FTDGTIRLSRLELEDEGVYICEFATFPTGNRESQLNL TVMAKPTNWIEGTQAVLRAKKGQDDKVLVATCTSA- NGKPPSVVSWETRLKGEAEYQEIRNPNGTVTVIS
RYRLVPSREAHQQSLACIVNYHMDRFKESLTLNV-
QYEPEVTIEGFDGNWYLQRMDVKLTCKADANPPAT
EYHWTFLNGSLPKGVEAQNRTLFFKG-
PINYSLAGTYICEATNPIGTRSGQVEVNIT corresponding to amino acids 1-334 of PVR1_HUMAN (SEQ ID NO:1432), which also corresponds to amino acids 1-334 of R66178_P3 (SEQ ID NO:1324), and a second amino acid sequence being at least 70%, optionally at least 80%, preferably at least 85%, more preferably at least 90% and most preferably at least 95% homologous to a polypeptide having the sequence GEGHSLPISPGVLQTQNCGP (SEQ ID NO: 694) corresponding to amino acids 335-354 of R66178_P3 (SEQ ID NO:1324), wherein said first amino acid sequence and second amino acid sequence are contiguous and in a sequential order.

2. An isolated polypeptide encoding for a tail of R66178_P3 (SEQ ID NO:1324), comprising a polypeptide being at least 70%, optionally at least about 80%, preferably at least about 85%, more preferably at least about 90% and most preferably at least about 95% homologous to the sequence GEGHSLPISPGVLQTQNCGP (SEQ ID NO: 694) in R66178_P3 (SEQ ID NO:1324).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P3 (SEQ ID NO:1324) also has the following non-silent SNPs (Single Nucleotide Polymorphisms) as listed in Table 416, (given according to their position(s) on the amino acid sequence, with the alternative amino acid(s) listed; the last column indicates whether the SNP is known or not; the presence of known SNPs in variant protein R66178_P3 (SEQ ID NO:1324) sequence provides support for the deduced sequence of this variant protein according to the present invention).

TABLE 416

Amino acid mutations

| SNP position(s) on amino acid sequence | Alternative amino acid(s) | Previously known SNP? |
|---|---|---|
| 77 | N -> S | No |

The glycosylation sites of variant protein R66178_P3 (SEQ ID NO:1324), as compared to the known protein Poliovirus receptor related protein 1 precursor (SEQ ID NO:1432), are described in Table 417 (given according to their position(s) on the amino acid sequence in the first column; the second column indicates whether the glycosylation site is present in the variant protein; and the last column indicates whether the position is different on the variant protein).

TABLE 417

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |
| 332 | yes | 332 |
| 139 | yes | 139 |
| 36 | yes | 36 |
| 286 | yes | 286 |

Variant protein R66178_P3 (SEQ ID NO:1324) is encoded by the following transcript(s): R66178_T2 (SEQ ID NO:48), for which the sequence(s) is/are given at the end of the application. The coding portion of transcript R66178_T2 (SEQ ID NO:48) is shown in bold; this coding portion starts at position 634 and ends at position 1695. The transcript also has the following SNPs as listed in Table 418 (given according to their position on the nucleotide sequence, with the alternative nucleic acid listed; the last column indicates whether the SNP is known or not; the presence of known SNPs in variant protein R66178_P3 (SEQ ID NO:1324) sequence provides support for the deduced sequence of this variant protein according to the present invention).

TABLE 418

Nucleic acid SNPs

| SNP position on nucleotide sequence | Alternative nucleic acid | Previously known SNP? |
|---|---|---|
| 474 | -> T | No |
| 476 | -> C | No |
| 632 | -> T | No |
| 633 | G -> T | No |
| 863 | A -> G | No |
| 897 | C -> T | Yes |
| 2178 | A -> G | No |
| 2465 | G -> A | Yes |
| 2687 | G -> A | Yes |

Variant protein R66178_P4 (SEQ ID NO:1325) according to the present invention has an amino acid sequence as given at the end of the application; it is encoded by transcript(s) R66178_T3 (SEQ ID NO:49). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison report between R66178_P4 (SEQ ID NO:1325) and PVR1_HUMAN (SEQ ID NO:1432):

1. An isolated chimeric polypeptide encoding for R66178_P4 (SEQ ID NO:1325), comprising a first amino acid sequence being at least 90% homologous to MARMGLAGAAGRWWGLALGLTAFFLPGVHSQVV-
QVNDSMYGFIGTDVVLHCSFANPLPSVKITQVTWQ
KSTNGSKQNVAIYNPSMGVSVLAPYRERVEFLRP-
SFTDGTIRLSRLELEDEGVYICEFATFPTGNRESQLNL
TVMAKPTNWIEGTQAVLRAKKGQDDKVLVATCTS-
ANGKPPSVVSWETRLKGEAEYQEIRNPNGTVTVIS
RYRLVPSREAHQQSLACIVNYHMDRFKESLTLN-
VQYEPEVTIEGFDGNWYLQRMDVKLTCKADANPPAT EYHWTTLNGSLPKGVEAQNRTLFFKG-
PINYSLAGTYICEATNPIGTRSGQVEVNIT corresponding to amino acids 1-334 of PVR1_HUMAN (SEQ ID NO:1432), which also corresponds to amino acids 1-334 of R66178_P4 (SEQ ID NO:1325), and a second amino acid sequence being at least 70%, optionally at least 80%, preferably at least 85%, more preferably at least 90% and most preferably at least 95% homologous to a polypeptide having the sequence AFCQLIYPGKGRTRARMF (SEQ ID NO:1702) corresponding to amino acids 335-352 of R66178_P4 (SEQ ID NO:1325), wherein said first amino acid sequence and second amino acid sequence are contiguous and in a sequential order.

2. An isolated polypeptide encoding for a tail of R66178_P4 (SEQ ID NO:1325), comprising a polypeptide being at least 70%, optionally at least about 80%, preferably at least about 85%, more preferably at least about 90% and most preferably at least about 95% homologous to the sequence AFCQLIYPGKGRTRARMF (SEQ ID NO: 1702) in R66178_P4 (SEQ ID NO:1325).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P4 (SEQ ID NO:1325) also has the following non-silent SNPs (Single Nucleotide Polymorphisms) as listed in Table 419, (given according to their position(s) on the amino acid sequence, with the alternative amino acid(s) listed; the last column indicates whether the SNP is known or not; the presence of known SNPs in variant protein R66178_P4 (SEQ ID NO:1325) sequence provides support for the deduced sequence of this variant protein according to the present invention).

TABLE 419

Amino acid mutations

| SNP position(s) on amino acid sequence | Alternative amino acid(s) | Previously known SNP? |
|---|---|---|
| 77 | N -> S | No |

The glycosylation sites of variant protein R66178_P4 (SEQ ID NO:1325), as compared to the known protein Poliovirus receptor related protein 1 precursor (SEQ ID NO:1432), are described in Table 420 (given according to their position(s) on the amino acid sequence in the first column; the second column indicates whether the glycosylation site is present in the variant protein; and the last column indicates whether the position is different on the variant protein).

TABLE 420

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |

TABLE 420-continued

Glycosylation site(s)

| Position(s) on known amino acid sequence | Present in variant protein? | Position in variant protein? |
|---|---|---|
| 332 | yes | 332 |
| 139 | yes | 139 |
| 36 | yes | 36 |
| 286 | yes | 286 |

Variant protein R66178_P4 (SEQ ID NO:1325) is encoded by the following transcript(s): R66178_T3 (SEQ ID NO:49), for which the sequence(s) is/are given at the end of the application. The coding portion of transcript R66178_T3 (SEQ ID NO:49) is shown in bold; this coding portion starts at position 634 and ends at position 1689. The transcript also has the following SNPs as listed in Table 421 (given according to their position on the nucleotide sequence, with the alternative nucleic acid listed; the last column indicates whether the SNP is known or not; the presence of known SNPs in variant protein R66178_P4 (SEQ ID NO:1325) sequence provides support for the deduced sequence of this variant protein according to the present invention).

TABLE 421

Nucleic acid SNPs

| SNP position on nucleotide sequence | Alternative nucleic acid | Previously known SNP? |
|---|---|---|
| 474 | -> T | No |
| 476 | -> C | No |
| 632 | -> T | No |
| 633 | G -> T | No |
| 863 | A -> G | No |
| 897 | C -> T | Yes |
| 1762 | C -> | Yes |

Variant protein R66178_P8 (SEQ ID NO:1326) according to the present invention has an amino acid sequence as given at the end of the application; it is encoded by transcript(s) R66178_T7 (SEQ ID NO:50). An alignment is given to the known protein (Poliovirus receptor related protein 1 precursor (SEQ ID NO:1432)) at the end of the application. One or more alignments to one or more previously published protein sequences are given at the end of the application. A brief description of the relationship of the variant protein according to the present invention to each such aligned protein is as follows:

Comparison report between R66178_P8 (SEQ ID NO:1326) and PVR1_HUMAN (SEQ ID NO:1432):

1. An isolated chimeric polypeptide encoding for R66178_P8 (SEQ ID NO:1326), comprising a first amino acid sequence being at least 90% homologous to MARMGLAGAAGRWWGLALGLTAFFLPGVHSQV-VQVNDSMYGFIGTDVVLHCSFANPLPSVKITQVTWQ KSTNGSKQNVAIYNPSMGVSVLAPYRERVEFLRPSF-TDGTIRLSRLELEDEGVYICEFATFPTGNRESQLNL TVMAKPTNWIEGTQAVLRAKKGQDDKVLVATCTSA-NGKPPSVVSWETRLKGEAEYQEIRNPNGTVTVIS RYRLVPSREAHQQSLACIVNYHMDRFKESLTLNV-QYEPEVTIEGFDGNWYLQRMDVKLTCKADANPPAT EYHWTTLNGSLPKGVEAQNRTLFFKGPINYSLAGT-YICEATNPIGTRSGQVE corresponding to amino acids 1-330 of PVR1_HUMAN (SEQ ID NO:1432), which also corresponds to amino acids 1-330 of R66178_P8 (SEQ ID NO:1326), and a second amino acid sequence being at least 70%, optionally at least 80%, preferably at least 85%, more preferably at least 90% and most preferably at least 95% homologous to a polypeptide having the sequence NSPT-PRLLPNMGGAPGRCPRPSLGAWRGASCWC (SEQ ID NO:1717) corresponding to amino acids 331-363 of R66178_P8 (SEQ ID NO:1326), wherein said first amino acid sequence and second amino acid sequence are contiguous and in a sequential order.

2. An isolated polypeptide encoding for a tail of R66178_P8 (SEQ ID NO:1326), comprising a polypeptide being at least 70%, optionally at least about 80%, preferably at least about 85%, more preferably at least about 90% and most preferably at least about 95% homologous to the sequence NSPTPRLLPNMGGAPGRCPRPSLGAWR-GASCWC (SEQ ID NO:1717) in R66178_P8 (SEQ ID NO:1326).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R66178_P8 (SEQ ID NO:1326) also has the following non-silent SNPs (Single Nucleotide Polymorphisms) as listed in Table 422, (given according to their position(s) on the amino acid sequence, with the alternative amino acid(s) listed; the last column indicates whether the SNP is known or not; the presence of known SNPs in variant protein R66178_P8 (SEQ ID NO:1326) sequence provides support for the deduced sequence of this variant protein according to the present invention).

TABLE 422

Amino acid mutations

| SNP position(s) on amino acid sequence | Alternative amino acid(s) | Previously known SNP? |
|---|---|---|
| 77 | N -> S | No |

The glycosylation sites of variant protein R66178_P8 (SEQ ID NO:1326), as compared to the known protein Poliovirus receptor related protein 1 precursor (SEQ ID NO:1432), are described in Table 423 (given according to their position(s) on the amino acid sequence in the first column; the second column indicates whether the glycosylation site is present in the variant protein; and the last column indicates whether the position is different on the variant protein).

TABLE 423

Glycosylation site(s)

| Position(s) on known amino acid sequence | Present in variant protein? | Position in variant protein? |
|---|---|---|
| 72 | yes | 72 |
| 297 | yes | 297 |
| 202 | yes | 202 |
| 307 | yes | 307 |
| 332 | no | |
| 139 | yes | 139 |
| 36 | yes | 36 |
| 286 | yes | 286 |

Variant protein R66178_P8 (SEQ ID NO:1326) is encoded by the following transcript(s): R66178_T7 (SEQ ID NO:50), for which the sequence(s) is/are given at the end of the application. The coding portion of transcript R66178_T7 (SEQ ID NO:50) is shown in bold; this coding portion starts at position 634 and ends at position 1722. The transcript also has the following SNPs as listed in Table 424 (given according to their position on the nucleotide sequence, with the alternative nucleic acid listed; the last column indicates whether the SNP is known or not; the presence of known SNPs in variant protein R66178_P8 (SEQ ID NO:1326) sequence provides support for the deduced sequence of this variant protein according to the present invention).

TABLE 424

Nucleic acid SNPs

| SNP position on nucleotide sequence | Alternative nucleic acid | Previously known SNP? |
|---|---|---|
| 474 | -> T | No |
| 476 | -> C | No |
| 632 | -> T | No |
| 633 | G -> T | No |
| 863 | A -> G | No |
| 897 | C -> T | Yes |
| 2210 | A -> C | No |
| 2211 | A -> C | No |

As noted above, cluster R66178 features 16 segment(s), which were listed in Table 414 above and for which the sequence(s) are given at the end of the application. These segment(s) are portions of nucleic acid sequence(s) which are described herein separately because they are of particular interest. A description of each segment according to the present invention is now provided.

Segment cluster R66178_node_0 (SEQ ID NO:502) according to the present invention is supported by 19 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 425 below describes the starting and ending position of this segment on each transcript.

TABLE 425

Segment location on transcripts

| Transcript name | Segment starting position | Segment ending position |
|---|---|---|
| R66178_T2 (SEQ ID NO:48) | 1 | 712 |
| R66178_T3 (SEQ ID NO:49) | 1 | 712 |
| R66178_T7 (SEQ ID NO:50) | 1 | 712 |

Segment cluster R66178_node_6 (SEQ ID NO:503) according to the present invention is supported by 39 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 426 below describes the starting and ending position of this segment on each transcript.

TABLE 426

Segment location on transcripts

| Transcript name | Segment starting position | Segment ending position |
|---|---|---|
| R66178_T2 (SEQ ID NO:48) | 762 | 1063 |
| R66178_T3 (SEQ ID NO:49) | 762 | 1063 |
| R66178_T7 (SEQ ID NO:50) | 762 | 1063 |

Segment cluster R66178_node_8 (SEQ ID NO:504) according to the present invention is supported by 39 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 427 below describes the starting and ending position of this segment on each transcript.

TABLE 427

Segment location on transcripts

| Transcript name | Segment starting position | Segment ending position |
|---|---|---|
| R66178_T2 (SEQ ID NO:48) | 1064 | 1269 |
| R66178_T3 (SEQ ID NO:49) | 1064 | 1269 |
| R66178_T7 (SEQ ID NO:50) | 1064 | 1269 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 428.

TABLE 428

Oligonucleotides related to this segment

| Oligonucleotide name | Overexpressed in cancers | Chip reference |
|---|---|---|
| R66178_0_7_0 (SEQ ID NO: 223) | lung malignant tumors | LUN |

Segment cluster R66178_node_15 (SEQ ID NO:505) according to the present invention is supported by 40 libraries. The number of libraries was determined as previously described. This segment can be found in the following transcript(s): R66178T2 (SEQ ID NO:48), R66178T3 (SEQ ID NO:49) and R66178_T7 (SEQ ID NO:50). Table 429 below describes the starting and ending position of this segment on each transcript.

TABLE 429

Segment location on transcripts

| Transcript name | Segment starting position | Segment ending position |
|---|---|---|
| R66178_T2 (SEQ ID NO:48) | 1485 | 1623 |
| R66178_T3 (SEQ ID NO:49) | 1485 | 1623 |
| R66178_T7 (SEQ ID NO:50) | 1485 | 1623 |

Segment cluster R66178_node_24 (SEQ ID NO:506) according to the present invention is supported by 10 libraries. The number of libraries was determined as previously described. This segment can be found in the following transcript(s): R66178_T2 (SEQ ID NO:48). Table 430 below describes the starting and ending position of this segment on each transcript.

TABLE 430

Segment location on transcripts

| Transcript name | Segment starting position | Segment ending position |
|---|---|---|
| R66178_T2 (SEQ ID NO:48) | 1637 | 3110 |

Segment cluster R66178_node_26 (SEQ ID NO:507) according to the present invention is supported by 24 libraries. The number of libraries was determined as previously described. This segment can be found in the following transcript(s): R66178_T7 (SEQ ID NO:50). Table 431 below describes the starting and ending position of this segment on each transcript.

TABLE 431

Segment location on transcripts

| Transcript name | Segment starting position | Segment ending position |
|---|---|---|
| R66178_T7 (SEQ ID NO:50) | 1624 | 2087 |

Segment cluster R66178_node_27 (SEQ ID NO:508) according to the present invention is supported by 12 libraries. The number of libraries was determined as previously described. This segment can be found in the following transcript(s): R66178_T7 (SEQ ID NO:50). Table 432 below describes the starting and ending position of this segment on each transcript.

TABLE 432

Segment location on transcripts

| Transcript name | Segment starting position | Segment ending position |
|---|---|---|
| R66178_T7 (SEQ ID NO:50) | 2088 | 2364 |

According to an optional embodiment of the present invention, short segments related to the above cluster are also provided. These segments are up to about 120 bp in length, and so are included in a separate description.

Segment cluster R66178_node_4 (SEQ ID NO:509) according to the present invention is supported by 21 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 433 below describes the starting and ending position of this segment on each transcript.

TABLE 433

Segment location on transcripts

| Transcript name | Segment starting position | Segment ending position |
|---|---|---|
| R66178_T2 (SEQ ID NO:48) | 713 | 749 |
| R66178_T3 (SEQ ID NO:49) | 713 | 749 |
| R66178_T7 (SEQ ID NO:50) | 713 | 749 |

Segment cluster R66178_node_5 (SEQ ID NO:510) according to the present invention can be found in the following transcript(s): R66178_T2 (SEQ ID NO:48), R66178_T3 (SEQ ID NO:49) and R66178_T7 (SEQ ID NO:50). Table 434 below describes the starting and ending position of this segment on each transcript.

TABLE 434

Segment location on transcripts

| Transcript name | Segment starting position | Segment ending position |
|---|---|---|
| R66178_T2 (SEQ ID NO:48) | 750 | 761 |
| R66178_T3 (SEQ ID NO:49) | 750 | 761 |
| R66178_T7 (SEQ ID NO:50) | 750 | 761 |

Segment cluster R66178_node_9 (SEQ ID NO:511) according to the present invention is supported by 44 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 435 below describes the starting and ending position of this segment on each transcript.

TABLE 435

Segment location on transcripts

| Transcript name | Segment starting position | Segment ending position |
|---|---|---|
| R66178_T2 (SEQ ID NO:48) | 1270 | 1366 |
| R66178_T3 (SEQ ID NO:49) | 1270 | 1366 |
| R66178_T7 (SEQ ID NO:50) | 1270 | 1366 |

Segment cluster R66178_node_11 (SEQ ID NO:512) according to the present invention is supported by 44 libraries. The number of libraries was determined as previously described. This segment can be found in the following transcript(s): R66178_T2 (SEQ ID NO:48), R66178_T3 (SEQ ID NO:49) and R66178_T7 (SEQ ID NO:50). Table 436 below describes the starting and ending position of this segment on each transcript.

TABLE 436

Segment location on transcripts

| Transcript name | Segment starting position | Segment ending position |
|---|---|---|
| R66178_T2 (SEQ ID NO:48) | 1367 | 1484 |
| R66178_T3 (SEQ ID NO:49) | 1367 | 1484 |
| R66178_T7 (SEQ ID NO:50) | 1367 | 1484 |

Segment cluster R66178_node_16 (SEQ ID NO:513) according to the present invention can be found in the following transcript(s): R66178_T2 (SEQ ID NO:48) and R66178_T3 (SEQ ID NO:49). Table 437 below describes the starting and ending position of this segment on each transcript.

TABLE 437

Segment location on transcripts

| Transcript name | Segment starting position | Segment ending position |
|---|---|---|
| R66178_T2 (SEQ ID NO:48) | 1624 | 1636 |
| R66178_T3 (SEQ ID NO:49) | 1624 | 1636 |

Segment cluster R66178_node_18 (SEQ ID NO:514) according to the present invention is supported by 13 libraries. The number of libraries was determined as previously described. This segment can be found in the following transcript(s): R66178_T3 (SEQ ID NO:49). Table 438 below describes the starting and ending position of this segment on each transcript.

TABLE 438

Segment location on transcripts

| Transcript name | Segment starting position | Segment ending position |
|---|---|---|
| R66178_T3 (SEQ ID NO:49) | 1637 | 1743 |

Segment cluster R66178_node_19 (SEQ ID NO:515) according to the present invention can be found in the following transcript(s): R66178_T3 (SEQ ID NO:49). Table 439 below describes the starting and ending position of this segment on each transcript.

TABLE 439

Segment location on transcripts

| Transcript name | Segment starting position | Segment ending position |
|---|---|---|
| R66178_T3 (SEQ ID NO:49) | 1744 | 1763 |

Segment cluster R66178_node_20 (SEQ ID NO:516) according to the present invention is supported by 12 libraries. The number of libraries was determined as previously described. This segment can be found in the following transcript(s): R66178_T3 (SEQ ID NO:49). Table 440 below describes the starting and ending position of this segment on each transcript.

TABLE 440

Segment location on transcripts

| Transcript name | Segment starting position | Segment ending position |
|---|---|---|
| R66178_T3 (SEQ ID NO:49) | 1764 | 1791 |

Segment cluster R66178_node_21 (SEQ ID NO:517) according to the present invention is supported by 11 libraries. The number of libraries was determined as previously described. This segment can be found in the following transcript(s): R66178_T3 (SEQ ID NO:49). Table 441 below describes the starting and ending position of this segment on each transcript.

TABLE 441

Segment location on transcripts

| Transcript name | Segment starting position | Segment ending position |
|---|---|---|
| R66178_T3 (SEQ ID NO:49) | 1792 | 1903 |

Variant protein alignment to the previously known protein:
Sequence name: PVR1_HUMAN (SEQ ID NO:1432)
Sequence documentation:

Alignment of: R66178_P3 (SEQ ID NO:1324) x PVR1_HUMAN (SEQ ID NO:1432) . . .

Alignment segment 1/1:

| | | | | |
|---|---|---|---|---|
| Quality: | 3286.00 | Escore: | 0 |
| Matching length: | 334 | Total length: | 334 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MARMGLAGAAGRWWGLALGLTAFFLPGVHSQVVQVNDSMYGFIGTDVVLH  50
    ||||||||||||||||||||||||||||||||||||||||||||||||||
  1 MARMGLAGAAGRWWGLALGLTAFFLPGVHSQVVQVNDSMYGFIGTDVVLH  50

51 CSFANPLPSVKITQVTWQKSTNGSKQNVAIYNPSMGVSVLAPYRERVEFL 100
    ||||||||||||||||||||||||||||||||||||||||||||||||||
 51 CSFANPLPSVKITQVTWQKSTNGSKQNVAIYNPSMGVSVLAPYRERVEFL 100

101 RPSFTDGTIRLSRLELEDEGVYICEFATFPTGNRESQLNLTVMAKPTNWI 150
    ||||||||||||||||||||||||||||||||||||||||||||||||||
101 RPSFTDGTIRLSRLELEDEGVYICEFATFPTGNRESQLNLTVMAKPTNWI 150

151 EGTQAVLRAKKGQDDKVLVATCTSANGKPPSVVSWETRLKGEAEYQEIRN 200
    ||||||||||||||||||||||||||||||||||||||||||||||||||
151 EGTQAVLRAKKGQDDKVLVATCTSANGKPPSVVSWETRLKGEAEYQEIRN 200

201 PNGTVTVISRYRLVPSREAHQQSLACIVNYHMDRFKESLTLNVQYEPEVT 250
    ||||||||||||||||||||||||||||||||||||||||||||||||||
201 PNGTVTVISRYRLVPSREAHQQSLACIVNYHMDRFKESLTLNVQYEPEVT 250

251 IEGFDGNWYLQRMDVKLTCKADANPPATEYHWTTLNGSLPKGVEAQNRTL 300
    ||||||||||||||||||||||||||||||||||||||||||||||||||
251 IEGFDGNWYLQRMDVKLTCKADANPPATEYHWTTLNGSLPKGVEAQNRTL 300

301 FFKGPINYSLAGTYICEATNPIGTRSGQVEVNIT 334
    |||||||||||||||||||||||||||||||||
301 FFKGPINYSLAGTYICEATNPIGTRSGQVEVNIT 334
```

Sequence name: PVR1_HUMAN (SEQ ID NO:1432)

Sequence documentation:

Alignment of: R66178_P4 (SEQ ID NO:1325) x PVR1HUMAN (SEQ ID NO:1432) . . .

Alignment segment 1/1:

| | | | | |
|---|---|---|---|---|
| Quality: | 3294.00 | Escore: | 0 |
| Matching length: | 336 | Total length: | 336 |
| Matching Percent Similarity: | 99.70 | Matching Percent Identity: | 99.70 |
| Total Percent Similarity: | 99.70 | Total Percent Identity: | 99.70 |
| Gaps: | 0 | | |

Alignment:

```
  1 MARMGLAGAAGRWWGLALGLTAFFLPGVHSQVVQVNDSMYGFIGTDVVLH  50
    ||||||||||||||||||||||||||||||||||||||||||||||||||
  1 MARMGLAGAAGRWWGLALGLTAFFLPGVHSQVVQVNDSMYGFIGTDVVLH  50

51 CSFANPLPSVKITQVTWQKSTNGSKQNVAIYNPSMGVSVLAPYRERVEFL 100
    ||||||||||||||||||||||||||||||||||||||||||||||||||
 51 CSFANPLPSVKITQVTWQKSTNGSKQNVAIYNPSMGVSVLAPYRERVEFL 100

101 RPSFTDGTIRLSRLELEDEGVYICEFATFPTGNRESQLNLTVMAKPTNWI 150
    ||||||||||||||||||||||||||||||||||||||||||||||||||
101 RPSFTDGTIRLSRLELEDEGVYICEFATFPTGNRESQLNLTVMAKPTNWI 150
```

-continued

```
151 EGTQAVLRAKKGQDDKVLVATCTSANGKPPSVVSWETRLKGEAEYQEIRN 200
    ||||||||||||||||||||||||||||||||||||||||||||||||||
151 EGTQAVLRAKKGQDDKVLVATCTSANGKPPSVVSWETRLKGEAEYQEIRN 200

201 PNGTVTVISRYRLVPSREAHQQSLACIVNYHMDRFKESLTLNVQYEPEVT 250
    ||||||||||||||||||||||||||||||||||||||||||||||||||
201 PNGTVTVISRYRLVPSREAHQQSLACIVNYHMDRFKESLTLNVQYEPEVT 250

251 IEGFDGNWYLQRMDVKLTCKADANPPATEYHWTTLNGSLPKGVEAQNRTL 300
    ||||||||||||||||||||||||||||||||||||||||||||||||||
251 IEGFDGNWYLQRMDVKLTCKADANPPATEYHWTTLNGSLPKGVEAQNRTL 300

301 FFKGPINYSLAGTYICEATNPIGTRSGQVEVNITAF              336
    |||||||||||||||||||||||||||||||||||
301 FFKGPINYSLAGTYICEATNPIGTRSGQVEVNITEF              336
```

Sequence name: PVR1_HUMAN (SEQ ID NO:1432)

Sequence documentation:

Alignment of: R66178_P8 (SEQ ID NO:1326) x PVR1_HUMAN (SEQ ID NO:1432) . . .

Alignment segment 1/1:

| Quality: | 3250.00 | Escore: | 0 |
|---|---|---|---|
| Matching length: | 330 | Total length: | 330 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MARMGLAGAAGRWWGLALGLTAFFLPGVHSQVVQVNDSMYGFIGTDVVLH  50
    ||||||||||||||||||||||||||||||||||||||||||||||||||
  1 MARMGLAGAAGRWWGLALGLTAFFLPGVHSQVVQVNDSMYGFIGTDVVLH  50

51 CSFANPLPSVKITQVTWQKSTNGSKQNVAIYNPSMGVSVLAPYRERVEFL 100
    ||||||||||||||||||||||||||||||||||||||||||||||||||
 51 CSFANPLPSVKITQVTWQKSTNGSKQNVAIYNPSMGVSVLAPYRERVEFL 100

101 RPSFTDGTIRLSRLELEDEGVYICEFATFPTGNRESQLNLTVMAKPTNWI 150
    ||||||||||||||||||||||||||||||||||||||||||||||||||
101 RPSFTDGTIRLSRLELEDEGVYICEFATFPTGNRESQLNLTVMAKPTNWI 150

151 EGTQAVLRAKKGQDDKVLVATCTSANGKPPSVVSWETRLKGEAEYQEIRN 200
    ||||||||||||||||||||||||||||||||||||||||||||||||||
151 EGTQAVLRAKKGQDDKVLVATCTSANGKPPSVVSWETRLKGEAEYQEIRN 200

201 PNGTVTVISRYRLVPSREAHQQSLACIVNYHMDRFKESLTLNVQYEPEVT 250
    ||||||||||||||||||||||||||||||||||||||||||||||||||
201 PNGTVTVISRYRLVPSREAHQQSLACIVNYHMDRFKESLTLNVQYEPEVT 250

251 IEGFDGNWYLQRMDVKLTCKADANPPATEYHWTTLNGSLPKGVEAQNRTL 300
    ||||||||||||||||||||||||||||||||||||||||||||||||||
251 IEGFDGNWYLQRMDVKLTCKADANPPATEYHWTTLNGSLPKGVEAQNRTL 300

301 FFKGPINYSLAGTYICEATNPIGTRSGQVE                    330
    ||||||||||||||||||||||||||||||
301 FFKGPINYSLAGTYICEATNPIGTRSGQVE                    330
```

Description for Cluster HUMPHOSLIP

Cluster HUMPHOSLIP features 7 transcript(s) and 53 segment(s) of interest, the names for which are given in Tables 442 and 443, respectively, the sequences themselves are given at the end of the application. The selected protein variants are given in table 444.

TABLE 442

Transcripts of interest

| Transcript Name | Sequence ID No. |
|---|---|
| HUMPHOSLIP_PEA_2_T6 | 51 |
| HUMPHOSLIP_PEA_2_T7 | 52 |
| HUMPHOSLIP_PEA_2_T14 | 53 |
| HUMPHOSLIP_PEA_2_T16 | 54 |
| HUMPHOSLIP_PEA_2_T17 | 55 |
| HUMPHOSLIP_PEA_2_T18 | 56 |
| HUMPHOSLIP_PEA_2_T19 | 57 |

TABLE 443

Segments of interest

| Segment Name | Sequence ID No. |
|---|---|
| HUMPHOSLIP_PEA_2_node_0 | 518 |
| HUMPHOSLIP_PEA_2_node_19 | 519 |
| HUMPHOSLIP_PEA_2_node_34 | 520 |

TABLE 443-continued

Segments of interest

| Segment Name | Sequence ID No. |
|---|---|
| HUMPHOSLIP_PEA_2_node_68 | 521 |
| HUMPHOSLIP_PEA_2_node_70 | 522 |
| HUMPHOSLIP_PEA_2_node_75 | 523 |
| HUMPHOSLIP_PEA_2_node_2 | 524 |
| HUMPHOSLIP_PEA_2_node_3 | 525 |
| HUMPHOSLIP_PEA_2_node_4 | 526 |
| HUMPHOSLIP_PEA_2_node_6 | 527 |
| HUMPHOSLIP_PEA_2_node_7 | 528 |
| HUMPHOSLIP_PEA_2_node_8 | 529 |
| HUMPHOSLIP_PEA_2_node_9 | 530 |
| HUMPHOSLIP_PEA_2_node_14 | 531 |
| HUMPHOSLIP_PEA_2_node_15 | 532 |
| HUMPHOSLIP_PEA_2_node_16 | 533 |
| HUMPHOSLIP_PEA_2_node_17 | 534 |
| HUMPHOSLIP_PEA_2_node_23 | 535 |
| HUMPHOSLIP_PEA_2_node_24 | 536 |
| HUMPHOSLIP_PEA_2_node_25 | 537 |
| HUMPHOSLIP_PEA_2_node_26 | 538 |
| HUMPHOSLIP_PEA_2_node_29 | 539 |
| HUMPHOSLIP_PEA_2_node_30 | 540 |
| HUMPHOSLIP_PEA_2_node_33 | 541 |
| HUMPHOSLIP_PEA_2_node_36 | 542 |
| HUMPHOSLIP_PEA_2_node_37 | 543 |
| HUMPHOSLIP_PEA_2_node_39 | 544 |
| HUMPHOSLIP_PEA_2_node_40 | 545 |
| HUMPHOSLIP_PEA_2_node_41 | 546 |
| HUMPHOSLIP_PEA_2_node_42 | 547 |
| HUMPHOSLIP_PEA_2_node_44 | 548 |
| HUMPHOSLIP_PEA_2_node_45 | 549 |
| HUMPHOSLIP_PEA_2_node_47 | 550 |
| HUMPHOSLIP_PEA_2_node_51 | 551 |
| HUMPHOSLIP_PEA_2_node_52 | 552 |
| HUMPHOSLIP_PEA_2_node_53 | 553 |
| HUMPHOSLIP_PEA_2_node_54 | 554 |
| HUMPHOSLIP_PEA_2_node_55 | 555 |
| HUMPHOSLIP_PEA_2_node_58 | 556 |
| HUMPHOSLIP_PEA_2_node_59 | 557 |
| HUMPHOSLIP_PEA_2_node_60 | 558 |
| HUMPHOSLIP_PEA_2_node_61 | 559 |
| HUMPHOSLIP_PEA_2_node_62 | 560 |
| HUMPHOSLIP_PEA_2_node_63 | 562 |
| HUMPHOSLIP_PEA_2_node_64 | 562 |
| HUMPHOSLIP_PEA_2_node_65 | 563 |
| HUMPHOSLIP_PEA_2_node_66 | 564 |
| HUMPHOSLIP_PEA_2_node_67 | 565 |
| HUMPHOSLIP_PEA_2_node_69 | 566 |
| HUMPHOSLIP_PEA_2_node_71 | 567 |
| HUMPHOSLIP_PEA_2_node_72 | 568 |
| HUMPHOSLIP_PEA_2_node_73 | 569 |
| HUMPHOSLIP_PEA_2_node_74 | 570 |

TABLE 444

Proteins of interest

| Protein Name | Sequence ID No. | Corresponding Transcript(s) |
|---|---|---|
| HUMPHOSLIP_PEA_2_P10 | 1327 | HUMPHOSLIP_PEA_2_T17 (SEQ ID NO:55) |
| HUMPHOSLIP_PEA_2_P12 | 1328 | HUMPHOSLIP_PEA_2_T19 (SEQ ID NO:57) |
| HUMPHOSLIP_PEA_2_P30 | 1329 | HUMPHOSLIP_PEA_2_T6 (SEQ ID NO:51) |
| HUMPHOSLIP_PEA_2_P31 | 1330 | HUMPHOSLIP_PEA_2_T7 (SEQ ID NO:52) |
| HUMPHOSLIP_PEA_2_P33 | 1331 | HUMPHOSLIP_PEA_2_T14 (SEQ ID NO:53) |
| HUMPHOSLIP_PEA_2_P34 | 1332 | HUMPHOSLIP_PEA_2_T16 (SEQ ID NO:54) |

TABLE 444-continued

Proteins of interest

| Protein Name | Sequence ID No. | Corresponding Transcript(s) |
|---|---|---|
| HUMPHOSLIP_PEA_2_P35 | 1333 | HUMPHOSLIP_PEA_2_T18 (SEQ ID NO:56) |

These sequences are variants of the known protein Phospholipid transfer protein precursor (SwissProt accession identifier PLTP_HUMAN; known also according to the synonyms Lipid transfer protein II), SEQ ID NO: 1433, referred to herein as the previously known protein.

Protein Phospholipid transfer protein precursor (SEQ ID NO:1433) is known or believed to have the following function(s): Converts HDL into larger and smaller particles. May play a key role in extracellular phospholipid transport and modulation of HDL particles. The sequence for protein Phospholipid transfer protein precursor is given at the end of the application, as "Phospholipid transfer protein precursor amino acid sequence". Known polymorphisms for this sequence are as shown in Table 445.

TABLE 445

Amino acid mutations for Known Protein

| SNP position(s) on amino acid sequence | Comment |
|---|---|
| 282 | R -> Q./FTId = VAR_017020. |
| 372 | R -> H./FTId = VAR_017021. |
| 380 | R -> W (in dbSNP:6065903)./FTId = VAR_017022. |
| 444 | F -> L (in dbSNP:1804161)./FTId = VAR_012073. |
| 487 | T -> K (in dbSNP:1056929)./FTId = VAR_012074. |
| 18 | E -> V |

Protein Phospholipid transfer protein precursor (SEQ ID NO:1433) localization is believed to be Secreted.

The following GO Annotation(s) apply to the previously known protein. The following annotation(s) were found: lipid metabolism; lipid transport, which are annotation(s) related to Biological Process; lipid binding, which are annotation(s) related to Molecular Function; and extracellular, which are annotation(s) related to Cellular Component.

The GO assignment relies on information from one or more of the SwissProt/TremBl Protein knowledgebase, available from <expasy dot ch/sprot/>; or Locuslink, available from <dot ncbi dot nlm dot nih dot gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 446, with regard to lung cancer.

TABLE 446

Oligonucleotides related to this cluster

| Oligonucleotide name | Overexpressed in cancers | Chip reference |
|---|---|---|
| HUMPHOSLIP_0_0_18458 (SEQ ID NO: 224) | lung malignant tumors | LUN |

As noted above, cluster HUMPHOSLIP features 7 transcript(s), which were listed in Table 1 above. These transcript(s) encode for protein(s) which are variant(s) of protein Phospholipid transfer protein precursor (SEQ ID NO:1433). A description of each variant protein according to the present invention is now provided.

Variant protein HUMPHOSLIP_PEA_2_P10 (SEQ ID NO:1327) according to the present invention has an amino acid sequence as given at the end of the application; it is encoded by transcript(s) HUMPHOSLIP_PEA_2_T17 (SEQ ID NO:55). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P10 (SEQ ID NO:1327) and PLTP_HUMAN (SEQ ID NO:1433):

1. An isolated chimeric polypeptide encoding for HUMPHOSLIP_PEA_2_P10 (SEQ ID NO:1327), comprising a first amino acid sequence being at least 90% homologous to MALFGALFLALLAGAHAEFPGCKIRVTSKALEL-VKQEGLRFLEQELETITIPDLRGKEGHFYYNISE corresponding to amino acids 1-67 of PLTP_HUMAN (SEQ ID NO:1433), which also corresponds to amino acids 1-67 of HUMPHOSLIP_ PEA_2_P10 (SEQ ID NO:1327), and a second amino acid sequence being at least 90% homologous to KVYDFLSTFITSGMRFLLNQQICPVLYHAGTVLLN-SLLDTVPVRSSVDELVGIDYSLMKDPVASTSNLDMD FRGAFFPLTERNWSLPNRAVEPQLQEEERMVYVAFS-EFFFDSAMESYFRAGALQLLLVGDKVPHDLDMLL RATYFGSIVLLSPAVIDSPLKLELRVLAPPRCTIKPS-GTTISVTASVTIALVPPDQPEVQLSSMTM-DARLSAK MALRGKALRTQLDLRRFRIYSNHSALE-SLALIPLQAPLKTMLQIGVMPMLNERT-WRGVQIPLPEGINFVHE VVTNHAGFLTIGADLH-FAKGLREVIEKNRPADVRASTAPTPSTAAV corresponding to amino acids 163-493 of PLTP_HUMAN (SEQ ID NO:1433), which also corresponds to amino acids 68-398 of HUMPHOSLIP_ PEA_2_P10 (SEQ ID NO:1327), wherein said first amino acid sequence and second amino acid sequence are contiguous and in a sequential order.

2. An isolated chimeric polypeptide encoding for an edge portion of HUMPHOSLIP_PEA_2_P10 (SEQ ID NO:1327), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EK, having a structure as follows: a sequence starting from any of amino acid numbers 67-x to 67; and ending at any of amino acid numbers 68+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P10 (SEQ ID NO:1327) also has the following non-silent SNPs (Single Nucleotide Polymorphisms) as listed in Table 447, (given according to their position(s) on the amino acid sequence, with the alternative amino acid(s) listed; the last column indicates whether the SNP is known or not; the presence of known SNPs in variant protein HUMPHOSLIP_PEA_2_P10 (SEQ ID NO:1327) sequence provides support for the deduced sequence of this variant protein according to the present invention).

TABLE 447

Amino acid mutations

| SNP position(s) on amino acid sequence | Alternative amino acid(s) | Previously known SNP? |
|---|---|---|
| 16 | H -> R | Yes |
| 18 | E -> V | Yes |
| 113 | S -> F | Yes |
| 118 | V -> | No |
| 140 | R -> | No |
| 140 | R -> P | No |
| 150 | N -> | No |
| 160 | P -> | No |
| 201 | P -> | No |
| 274 | M -> | No |
| 285 | R -> W | Yes |
| 292 | Q -> | No |
| 315 | L -> * | No |
| 330 | M -> I | Yes |
| 349 | F -> L | Yes |
| 392 | T -> K | Yes |

The glycosylation sites of variant protein HUMPHOSLIP_PEA_2_P10 (SEQ ID NO:1327), as compared to the known protein Phospholipid transfer protein precursor (SEQ ID NO:1433), are described in Table 448 (given according to their position(s) on the amino acid sequence in the first column; the second column indicates whether the glycosylation site is present in the variant protein; and the last column indicates whether the position is different on the variant protein).

TABLE 448

Glycosylation site(s)

| Position(s) on known amino acid sequence | Present in variant protein? | Position in variant protein? |
|---|---|---|
| 94 | no | |
| 143 | no | |
| 64 | yes | 64 |
| 245 | yes | 150 |
| 398 | yes | 303 |
| 117 | no | |

Variant protein HUMPHOSLIP_PEA_2_P10 (SEQ ID NO:1327) is encoded by the following transcript(s): HUMPHOSLIP_PEA_2_T17 (SEQ ID NO:55), for which the sequence(s) is/are given at the end of the application. The coding portion of transcript HUMPHOSLIP_PEA_2_T17 (SEQ ID NO:55) is shown in bold; this coding portion starts at position 276 and ends at position 1469. The transcript also has the following SNPs as listed in Table 449 (given according to their position on the nucleotide sequence, with the alternative nucleic acid listed; the last column indicates whether the SNP is known or not; the presence of known SNPs in variant protein HUMPHOSLIP_PEA_2_P10 (SEQ ID NO:1327) sequence provides support for the deduced sequence of this variant protein according to the present invention).

TABLE 449

Nucleic acid SNPs

| SNP position on nucleotide sequence | Alternative nucleic acid | Previously known SNP? |
| --- | --- | --- |
| 174 | G -> T | No |
| 175 | A -> T | No |
| 322 | A -> G | Yes |
| 328 | A -> T | Yes |
| 431 | G -> A | Yes |
| 551 | C -> T | Yes |
| 613 | C -> T | Yes |
| 628 | T -> | No |
| 694 | G -> | No |
| 694 | G -> C | No |
| 723 | A -> | No |
| 753 | C -> | No |
| 876 | C -> | No |
| 1037 | C -> T | Yes |
| 1097 | G -> | No |
| 1128 | C -> T | Yes |
| 1149 | C -> | No |
| 1219 | T -> A | No |
| 1230 | C -> T | Yes |
| 1265 | G -> C | Yes |
| 1322 | T -> A | Yes |
| 1450 | C -> A | Yes |
| 1469 | C -> T | No |
| 1549 | C -> T | Yes |
| 1565 | A -> G | No |
| 1565 | A -> T | No |
| 1630 | A -> G | Yes |
| 1654 | T -> A | No |
| 1731 | G -> T | Yes |
| 1864 | G -> A | Yes |
| 1893 | G -> T | Yes |
| 2073 | G -> A | Yes |
| 2269 | C -> T | Yes |
| 2325 | G -> T | Yes |
| 2465 | C -> T | Yes |
| 2566 | C -> T | Yes |
| 2881 | A -> G | No |

Variant protein HUMPHOSLIP_PEA_2_P12 (SEQ ID NO:1328) according to the present invention has an amino acid sequence as given at the end of the application; it is encoded by transcript(s) HUMPHOSLIP_PEA_2_T19 (SEQ ID NO:57). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P12 (SEQ ID NO:1328) and PLTP_HUMAN (SEQ ID NO:1433):

1. An isolated chimeric polypeptide encoding for HUMPHOSLIP_PEA_2_P12 (SEQ ID NO:1328), comprising a first amino acid sequence being at least 90% homologous to MALFGALFLALLAGAHAEFPGCKIRVTSKALELVK- QEGLRFLEQELETITIPDLRGKEGHFYYNISEVKVTE LQLTSSELDFQPQQELMLQITNASLGLRFRRQLLYW- FFYDGGYINASAEGVSIRTGLELSRDPAGRMKVSN VSCQASVSRMHAAFGGTFKKVYDFLSTFITSGMRFL- LNQQICPVLYHAGTVLLNSLLDTVPVRSSVDELVG IDYSLMKDPVASTSNLDMDFRGAFFPLTERNWS- LPNRAVEPQLQEEERMVYVAFSEFFFDSAMESYFR- AG ALQLLLVGDKVPHDLDMLLRATYFGSIVLLSPAV- IDSPLKLELRVLAPPRCTIKPSGTTISVTASVTIALVPP DQPEVQLSSMTMDARLSAKMALRGKAL- RTQLDLRRFRIYSNHSALESLALIPLQA- PLKTMLQIGVMPMLN corresponding to amino acids 1-427 of PLTP_HUMAN (SEQ ID NO:1433), which also corresponds to amino acids 1-427 of HUMPHOSLIP_PEA_2_P12 (SEQ ID NO:1328), and a second amino acid sequence being at least 70%, optionally at least 80%, preferably at least 85%, more preferably at least 90% and most preferably at least 95% homologous to a polypeptide having the sequence GKAGV (SEQ ID NO: 263) corresponding to amino acids 428-432 of HUMPHOSLIP_PEA_2_P12 (SEQ ID NO:1328), wherein said first amino acid sequence and second amino acid sequence are contiguous and in a sequential order.

2. An isolated polypeptide encoding for a tail of HUMPHOSLIP_PEA_2_P12 (SEQ ID NO:1328), comprising a polypeptide being at least 70%, optionally at least about 80%, preferably at least about 85%, more preferably at least about 90% and most preferably at least about 95% homologous to the sequence GKAGV (SEQ ID NO: 263) in HUMPHOSLIP_PEA_2_P12 (SEQ ID NO:1328).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P12 (SEQ ID NO:1328) also has the following non-silent SNPs (Single Nucleotide Polymorphisms) as listed in Table 450, (given according to their position(s) on the amino acid sequence, with the alternative amino acid(s) listed; the last column indicates whether the SNP is known or not; the presence of known SNPs in variant protein HUMPHOSLIP_PEA_2_P12 (SEQ ID NO:1328) sequence provides support for the deduced sequence of this variant protein according to the present invention).

TABLE 450

Amino acid mutations

| SNP position(s) on amino acid sequence | Alternative amino acid(s) | Previously known SNP? |
| --- | --- | --- |
| 16 | H -> R | Yes |
| 18 | E -> V | Yes |
| 81 | D -> H | Yes |
| 124 | S -> Y | Yes |
| 160 | T -> | No |
| 160 | T -> N | No |
| 208 | S -> F | Yes |

TABLE 450-continued

Amino acid mutations

| SNP position(s) on amino acid sequence | Alternative amino acid(s) | Previously known SNP? |
|---|---|---|
| 213 | V -> | No |
| 235 | R -> P | No |
| 235 | R -> | No |
| 245 | N -> | No |
| 255 | P -> | No |
| 296 | P -> | No |
| 369 | M -> | No |
| 380 | R -> W | Yes |
| 387 | Q -> | No |
| 410 | L -> * | No |
| 425 | M -> I | Yes |

The glycosylation sites of variant protein HUMPHOSLIP_PEA_2_P12 (SEQ ID NO:1328), as compared to the known protein Phospholipid transfer protein precursor (SEQ ID NO:1433), are described in Table 451 (given according to their position(s) on the amino acid sequence in the first column; the second column indicates whether the glycosylation site is present in the variant protein; and the last column indicates whether the position is different on the variant protein).

TABLE 451

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | yes | 245 |
| 398 | yes | 398 |
| 117 | yes | 117 |

Variant protein HUMPHOSLIP_PEA_2_P12 (SEQ ID NO:1328) is encoded by the following transcript(s): HUMPHOSLIP_PEA_2_T19 (SEQ ID NO:57), for which the sequence(s) is/are given at the end of the application. The coding portion of transcript HUMPHOSLIP_PEA_2_T19 (SEQ ID NO:57) is shown in bold; this coding portion starts at position 276 and ends at position 1571. The transcript also has the following SNPs as listed in Table 452 (given according to their position on the nucleotide sequence, with the alternative nucleic acid listed; the last column indicates whether the SNP is known or not; the presence of known SNPs in variant protein HUMPHOSLIP_PEA_2_P12 (SEQ ID NO:1328) sequence provides support for the deduced sequence of this variant protein according to the present invention).

TABLE 452

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |

TABLE 452-continued

Nucleic acid SNPs

| SNP position on nucleotide sequence | Alternative nucleic acid | Previously known SNP? |
|---|---|---|
| 644 | G -> A | Yes |
| 646 | C -> A | Yes |
| 754 | C -> | No |
| 754 | C -> A | No |
| 836 | C -> T | Yes |
| 898 | C -> T | Yes |
| 913 | T -> | No |
| 979 | G -> | No |
| 979 | G -> C | No |
| 1008 | A -> | No |
| 1038 | C -> | No |
| 1161 | C -> | No |
| 1322 | C -> T | Yes |
| 1382 | G -> | No |
| 1413 | C -> T | Yes |
| 1434 | C -> | No |
| 1504 | T -> A | No |
| 1515 | C -> T | Yes |
| 1550 | G -> C | Yes |
| 1690 | T -> A | Yes |
| 1818 | C -> A | Yes |
| 1837 | C -> T | No |
| 1917 | C -> T | Yes |
| 1933 | A -> G | No |
| 1933 | A -> T | No |
| 1998 | A -> G | Yes |
| 2022 | T -> A | No |
| 2099 | G -> T | Yes |
| 2232 | G -> A | Yes |
| 2261 | G -> T | Yes |
| 2441 | G -> A | Yes |
| 2637 | C -> T | Yes |
| 2693 | G -> T | Yes |
| 2833 | C -> T | Yes |
| 2934 | C -> T | Yes |
| 3249 | A -> G | No |

Variant protein HUMPHOSLIP_PEA_2_P30 (SEQ ID NO:1329) according to the present invention has an amino acid sequence as given at the end of the application; it is encoded by transcript(s) HUMPHOSLIP_PEA_2_T6 (SEQ ID NO:51). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P30 (SEQ ID NO:1329) also has the following non-silent SNPs (Single Nucleotide Polymorphisms) as listed in Table 453, (given according to their position(s) on the amino acid sequence, with the alternative amino acid(s) listed; the last column indicates whether the SNP is known or not; the presence of known SNPs in variant protein HUMPHOSLIP_PEA_2_P30 (SEQ ID NO:1329) sequence provides support for the deduced sequence of this variant protein according to the present invention).

TABLE 453

Amino acid mutations

| SNP position(s) on amino acid sequence | Alternative amino acid(s) | Previously known SNP? |
|---|---|---|
| 16 | H -> R | Yes |
| 18 | E -> V | Yes |
| 37 | R -> Q | Yes |

Variant protein HUMPHOSLIP_PEA_2_P30 (SEQ ID NO:1329) is encoded by the following transcript(s): HUMPHOSLIP_PEA_2_T6 (SEQ ID NO:51), for which the sequence(s) is/are given at the end of the application. The coding portion of transcript HUMPHOSLIP_PEA_2_T6 (SEQ ID NO:51) is shown in bold; this coding portion starts at position 276 and ends at position 431. The transcript also has the following SNPs as listed in Table 454 (given according to their position on the nucleotide sequence, with the alternative nucleic acid listed; the last column indicates whether the SNP is known or not; the presence of known SNPs in variant protein HUMPHOSLIP_PEA_2_P30 (SEQ ID NO:1329) sequence provides support for the deduced sequence of this variant protein according to the present invention).

TABLE 454

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 385 | G -> A | Yes |
| 470 | G -> C | Yes |
| 598 | G -> A | Yes |
| 600 | C -> A | Yes |
| 708 | C -> | No |
| 708 | C -> A | No |
| 790 | C -> T | Yes |
| 852 | C -> T | Yes |
| 867 | T -> | No |
| 933 | G -> | No |
| 933 | G -> C | No |
| 962 | A -> | No |
| 992 | C -> | No |
| 1115 | C -> | No |
| 1276 | C -> T | Yes |
| 1336 | G -> | No |
| 1367 | C -> T | Yes |
| 1388 | C -> | No |
| 1458 | T -> A | No |
| 1469 | C -> T | Yes |
| 1504 | G -> C | Yes |
| 1561 | T -> A | Yes |
| 1689 | C -> A | Yes |
| 1708 | C -> T | No |
| 1788 | C -> T | Yes |
| 1804 | A -> G | No |
| 1804 | A -> T | No |
| 1869 | A -> G | Yes |
| 1893 | T -> A | No |
| 1970 | G -> T | Yes |
| 2103 | G -> A | Yes |
| 2132 | G -> T | Yes |
| 2312 | G -> A | Yes |
| 2508 | C -> T | Yes |
| 2564 | G -> T | Yes |
| 2704 | C -> T | Yes |
| 2805 | C -> T | Yes |
| 3120 | A -> G | No |

Variant protein HUMPHOSLIP_PEA_2_P31 (SEQ ID NO:1330) according to the present invention has an amino acid sequence as given at the end of the application; it is encoded by transcript(s) HUMPHOSLIP_PEA_2_T7 (SEQ ID NO:52). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P31 (SEQ ID NO:1330) and PLTP_HUMAN (SEQ ID NO:1433):

1. An isolated chimeric polypeptide encoding for HUMPHOSLIP_PEA_2_P31 (SEQ ID NO:1330), comprising a first amino acid sequence being at least 90% homologous to MALFGALFLALLAGAHAEFPGCK-IRVTSKALELVKQEGLRFLEQE-LETITIPDLRGKEGHFYYNISE corresponding to amino acids 1-67 of PLTP_HUMAN (SEQ ID NO:1433), which also corresponds to amino acids 1-67 of HUMPHOSLIP_PEA_2_P31 (SEQ ID NO:1330), and a second amino acid sequence being at least 70%, optionally at least 80%, preferably at least 85%, more preferably at least 90% and most preferably at least 95% homologous to a polypeptide having the sequence PGLERGADKFPVVGGSSLFLALDLTLRP-PVG (SEQ ID NO: 264) corresponding to amino acids 68-98 of HUMPHOSLIP_PEA_2_P31 (SEQ ID NO:1330), wherein said first amino acid sequence and second amino acid sequence are contiguous and in a sequential order.

2. An isolated polypeptide encoding for a tail of HUMPHOSLIP_PEA_2_P31 (SEQ ID NO:1330), comprising a polypeptide being at least 70%, optionally at least about 80%, preferably at least about 85%, more preferably at least about 90% and most preferably at least about 95% homologous to the sequence PGLERGADKFPVVGGSSLFLALDLTLRP-PVG (SEQ ID NO: 264) in HUMPHOSLIP_PEA_2_P31 (SEQ ID NO:1330).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P31 (SEQ ID NO:1330) also has the following non-silent SNPs (Single Nucleotide Polymorphisms) as listed in Table 455, (given according to their position(s) on the amino acid sequence, with the alternative amino acid(s) listed; the last column indicates whether the SNP is known or not; the presence of known SNPs in variant protein HUMPHOSLIP_PEA_2_P31 (SEQ ID NO:1330) sequence provides support for the deduced sequence of this variant protein according to the present invention).

TABLE 455

Amino acid mutations

| SNP position(s) on amino acid sequence | Alternative amino acid(s) | Previously known SNP? |
|---|---|---|
| 16 | H -> R | Yes |
| 18 | E -> V | Yes |

The glycosylation sites of variant protein HUMPHOSLIP_PEA_2_P31 (SEQ ID NO:1330), as compared to the known protein Phospholipid transfer protein precursor (SEQ ID NO:1433), are described in Table 456 (given according to their position(s) on the amino acid sequence in the first column; the second column indicates whether the glycosylation site is present in the variant protein; and the last column indicates whether the position is different on the variant protein).

TABLE 456

Glycosylation site(s)

| Position(s) on known amino acid sequence | Present in variant protein? | Position in variant protein? |
|---|---|---|
| 94 | no | |
| 143 | no | |
| 64 | yes | 64 |
| 245 | no | |
| 398 | no | |
| 117 | no | |

Variant protein HUMPHOSLIP_PEA_2_P31 (SEQ ID NO:1330) is encoded by the following transcript(s): HUMPHOSLIP_PEA_2_T7 (SEQ ID NO:52), for which the sequence(s) is/are given at the end of the application. The coding portion of transcript HUMPHOSLIP_PEA_2_T7 (SEQ ID NO:52) is shown in bold; this coding portion starts at position 276 and ends at position 569. The transcript also has the following SNPs as listed in Table 457 (given according to their position on the nucleotide sequence, with the alternative nucleic acid listed; the last column indicates whether the SNP is known or not; the presence of known SNPs in variant protein HUMPHOSLIP_PEA_2_P31 (SEQ ID NO:1330) sequence provides support for the deduced sequence of this variant protein according to the present invention).

TABLE 457

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 608 | G -> C | Yes |
| 736 | G -> A | Yes |
| 738 | C -> A | Yes |
| 846 | C -> | No |
| 846 | C -> A | No |
| 928 | C -> T | Yes |
| 990 | C -> T | Yes |
| 1005 | T -> | No |
| 1071 | G -> | No |
| 1071 | G -> C | No |

TABLE 457-continued

Nucleic acid SNPs

| SNP position on nucleotide sequence | Alternative nucleic acid | Previously known SNP? |
|---|---|---|
| 1100 | A -> | No |
| 1130 | C -> | No |
| 1253 | C -> | No |
| 1414 | C -> T | Yes |
| 1474 | G -> | No |
| 1505 | C -> T | Yes |
| 1526 | C -> | No |
| 1596 | T -> A | No |
| 1607 | C -> T | Yes |
| 1642 | G -> C | Yes |
| 1699 | T -> A | Yes |
| 1827 | C -> A | Yes |
| 1846 | C -> T | No |
| 1926 | C -> T | Yes |
| 1942 | A -> G | No |
| 1942 | A -> T | No |
| 2007 | A -> G | Yes |
| 2031 | T -> A | No |
| 2108 | G -> T | Yes |
| 2241 | G -> A | Yes |
| 2270 | G -> T | Yes |
| 2450 | G -> A | Yes |
| 2646 | C -> T | Yes |
| 2702 | G -> T | Yes |
| 2842 | C -> T | Yes |
| 2943 | C -> T | Yes |
| 3258 | A -> G | No |

Variant protein HUMPHOSLIP_PEA_2_P33 (SEQ ID NO:1331) according to the present invention has an amino acid sequence as given at the end of the application; it is encoded by transcript(s) HUMPHOSLIP_PEA_2_T14 (SEQ ID NO:53). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P33 (SEQ ID NO:1331) and PLTP_HUMAN (SEQ ID NO:1433):

1. An isolated chimeric polypeptide encoding for HUMPHOSLIP_PEA_2_P33 (SEQ ID NO:1331), comprising a first amino acid sequence being at least 90% homologous to MALFGALFLALLAGAHAEFPGCKIRVTSKALELV-KQEGLRFLEQELETITIPDLRGKEGHFYYNISEVKVTE LQLTSSELDFQPQQELMLQITNASLGLRFRRQLLYW-FFYDGGYINASAEGVSIRTGLELSRDPAGRMKVSN VSCQASVSRMHAAFGGTFKKVYDFLSTFITSGMRF-LLNQQ corresponding to amino acids 1-183 of PLTP_HUMAN (SEQ ID NO:1433), which also corresponds to amino acids 1-183 of HUMPHOSLIP_PEA_2_P33 (SEQ ID NO:1331), and a second amino acid sequence being at least 70%, optionally at least 80%, preferably at least 85%, more preferably at least 90% and most preferably at least 95% homologous to a polypeptide having the sequence VWAAT-GRRVARVGMLSL (SEQ ID NO: 265) corresponding to amino acids 184-200 of HUMPHOSLIP_PEA_2_P33 (SEQ ID NO:1331), wherein said first amino acid sequence and second amino acid sequence are contiguous and in a sequential order.

2. An isolated polypeptide encoding for a tail of HUMPHOSLIP_PEA_2_P33 (SEQ ID NO:1331), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 265) in HUMPHOSLIP_PEA_2_P33 (SEQ ID NO:1331).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P33 (SEQ ID NO:1331) also has the following non-silent SNPs (Single Nucleotide Polymorphisms) as listed in Table 458, (given according to their position(s) on the amino acid sequence, with the alternative amino acid(s) listed; the last column indicates whether the SNP is known or not; the presence of known SNPs in variant protein HUMPHOSLIP_PEA_2_P33 (SEQ ID NO:1331) sequence provides support for the deduced sequence of this variant protein according to the present invention).

TABLE 458

Amino acid mutations

| SNP position(s) on amino acid sequence | Alternative amino acid(s) | Previously known SNP? |
|---|---|---|
| 16 | H -> R | Yes |
| 18 | E -> V | Yes |
| 81 | D -> H | Yes |
| 124 | S -> Y | Yes |
| 160 | T -> | No |
| 160 | T -> N | No |

The glycosylation sites of variant protein HUMPHOSLIP_PEA_2_P33 (SEQ ID NO:1331), as compared to the known protein Phospholipid transfer protein precursor (SEQ ID NO:1433), are described in Table 459 (given according to their position(s) on the amino acid sequence in the first column; the second column indicates whether the glycosylation site is present in the variant protein; and the last column indicates whether the position is different on the variant protein).

TABLE 459

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P33 (SEQ ID NO:1331) is encoded by the following transcript(s): HUMPHOSLIP_PEA_2_T14 (SEQ ID NO:53), for which the sequence(s) is/are given at the end of the application. The coding portion of transcript HUMPHOSLIP_PEA_2_T14 (SEQ ID NO:53) is shown in bold; this coding portion starts at position 276 and ends at position 875. The transcript also has the following SNPs as listed in Table 460 (given according to their position on the nucleotide sequence, with the alternative nucleic acid listed; the last column indicates whether the SNP is known or not; the presence of known SNPs in variant protein HUMPHOSLIP_PEA_2_P33 (SEQ ID NO:1331) sequence provides support for the deduced sequence of this variant protein according to the present invention).

TABLE 460

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 644 | G -> A | Yes |
| 646 | C -> A | Yes |
| 754 | C -> | No |
| 754 | C -> A | No |
| 921 | C -> T | Yes |
| 983 | C -> T | Yes |
| 998 | T -> | No |
| 1064 | G -> | No |
| 1064 | G -> C | No |
| 1093 | A -> | No |
| 1123 | C -> | No |
| 1246 | C -> | No |
| 1407 | C -> T | Yes |
| 1467 | G -> | No |
| 1498 | C -> T | Yes |
| 1519 | C -> | No |
| 1589 | T -> A | No |
| 1600 | C -> T | Yes |
| 1635 | G -> C | Yes |
| 1692 | T -> A | Yes |
| 1820 | C -> A | Yes |
| 1839 | C -> T | No |
| 1919 | C -> T | Yes |
| 1935 | A -> G | No |
| 1935 | A -> T | No |
| 2000 | A -> G | Yes |
| 2024 | T -> A | No |
| 2101 | G -> T | Yes |
| 2234 | G -> A | Yes |
| 2263 | G -> T | Yes |
| 2443 | G -> A | Yes |
| 2639 | C -> T | Yes |
| 2695 | G -> T | Yes |
| 2835 | C -> T | Yes |
| 2936 | C -> T | Yes |
| 3251 | A -> G | No |

Variant protein HUMPHOSLIP_PEA_2_P34 (SEQ ID NO:1332) according to the present invention has an amino acid sequence as given at the end of the application; it is encoded by transcript(s) HUMPHOSLIP_PEA_2_T16 (SEQ ID NO:54). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA_2_P34 (SEQ ID NO:1332) and PLTP_HUMAN (SEQ ID NO:1433):

1. An isolated chimeric polypeptide encoding for HUMPHOSLIP_PEA_2_P34 (SEQ ID NO:1332), comprising a first amino acid sequence being at least 90% homologous to MALFGALFLALLAGAHAEFPGCK- IRVTSKALELVKQEGLRFLEQELETITIPDLR-
GKEGHFYYNISEVKVTE LQLTSSELDFQPQQELML-
QITNASLGLRFRRQLLYWFFYDGGYINASAEGV-
SIRTGLELSRDPAGRMKVSN VSCQASVSRMHAAFG-
GTFKKVYDFLSTFITSGMRFLLNQQICPVLYHA-
GTVLLNSLLDTVPV corresponding to amino acids 1-205 of PLTP_HUMAN (SEQ ID NO:1433), which also corresponds to amino acids 1-205 of HUMPHOSLIP_PEA_2_P34 (SEQ ID NO:1332), and a second amino acid sequence being at least 70%, optionally at least 80%, preferably at least 85%, more preferably at least 90% and most preferably at least 95% homologous to a polypeptide having the sequence LWTSLLALTIPS (SEQ ID NO: 266) corresponding to amino acids 206-217 of HUMPHOSLIP_PEA_2_P34 (SEQ ID NO:1332), wherein said first amino acid sequence and second amino acid sequence are contiguous and in a sequential order.

2. An isolated polypeptide encoding for a tail of HUMPHOSLIP_PEA_2_P34 (SEQ ID NO:1332), comprising a polypeptide being at least 70%, optionally at least about 80%, preferably at least about 85%, more preferably at least about 90% and most preferably at least about 95% homologous to the sequence LWTSLLALTIPS (SEQ ID NO: 266) in HUMPHOSLIP_PEA_2_P34 (SEQ ID NO:1332).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA_2_P34 (SEQ ID NO:1332) also has the following non-silent SNPs (Single Nucleotide Polymorphisms) as listed in Table 461, (given according to their position(s) on the amino acid sequence, with the alternative amino acid(s) listed; the last column indicates whether the SNP is known or not; the presence of known SNPs in variant protein HUMPHOSLIP_PEA_2_P34 (SEQ ID NO:1332) sequence provides support for the deduced sequence of this variant protein according to the present invention).

TABLE 461

Amino acid mutations

| SNP position(s) on amino acid sequence | Alternative amino acid(s) | Previously known SNP? |
|---|---|---|
| 16 | H -> R | Yes |
| 18 | E -> V | Yes |
| 81 | D -> H | Yes |
| 124 | S -> Y | Yes |
| 160 | T -> | No |
| 160 | T -> N | No |
| 211 | L > | No |

The glycosylation sites of variant protein HUMPHOSLIP_PEA_2_P34 (SEQ ID NO:1332), as compared to the known protein Phospholipid transfer protein precursor (SEQ ID NO:1433), are described in Table 462 (given according to their position(s) on the amino acid sequence in the first column; the second column indicates whether the glycosylation site is present in the variant protein; and the last column indicates whether the position is different on the variant protein).

TABLE 462

Glycosylation site(s)

| Position(s) on known amino acid sequence | Present in variant protein? | Position in variant protein? |
|---|---|---|
| 94 | yes | 94 |
| 143 | yes | 143 |
| 64 | yes | 64 |
| 245 | no | |
| 398 | no | |
| 117 | yes | 117 |

Variant protein HUMPHOSLIP_PEA_2_P34 (SEQ ID NO:1332) is encoded by the following transcript(s): HUMPHOSLIP_PEA_2_T16 (SEQ ID NO:54), for which the sequence(s) is/are given at the end of the application. The coding portion of transcript HUMPHOSLIP_PEA_2_T16 (SEQ ID NO:54) is shown in bold; this coding portion starts at position 276 and ends at position 926. The transcript also has the following SNPs as listed in Table 463 (given according to their position on the nucleotide sequence, with the alternative nucleic acid listed; the last column indicates whether the SNP is known or not; the presence of known SNPs in variant protein HUMPHOSLIP_PEA_2_P34 (SEQ ID NO:1332) sequence provides support for the deduced sequence of this variant protein according to the present invention).

TABLE 463

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 644 | G -> A | Yes |
| 646 | C -> A | Yes |
| 754 | C -> | No |
| 754 | C -> A | No |
| 836 | C -> T | Yes |
| 891 | C -> T | Yes |
| 906 | T -> | No |
| 972 | G -> | No |
| 972 | G -> C | No |
| 1001 | A -> | No |
| 1031 | C -> | No |
| 1154 | C -> | No |
| 1315 | C -> T | Yes |
| 1375 | G -> | No |
| 1406 | C -> T | Yes |
| 1427 | C -> | No |
| 1497 | T -> A | No |
| 1508 | C -> T | Yes |
| 1543 | G -> C | Yes |
| 1600 | T -> A | Yes |
| 1728 | C -> A | Yes |
| 1747 | C -> T | No |
| 1827 | C -> T | Yes |
| 1843 | A -> G | No |
| 1843 | A -> T | No |
| 1908 | A -> G | Yes |
| 1932 | T -> A | No |
| 2009 | G -> T | Yes |
| 2142 | G -> A | Yes |
| 2171 | G -> T | Yes |
| 2351 | G -> A | Yes |
| 2547 | C -> T | Yes |
| 2603 | G -> T | Yes |

TABLE 463-continued

Nucleic acid SNPs

| SNP position on nucleotide sequence | Alternative nucleic acid | Previously known SNP? |
|---|---|---|
| 2743 | C -> T | Yes |
| 2844 | C -> T | Yes |
| 3159 | A -> G | No |

Variant protein HUMPHOSLIP_PEA__2_P35 (SEQ ID NO:1333) according to the present invention has an amino acid sequence as given at the end of the application; it is encoded by transcript(s) HUMPHOSLIP_PEA__2_T18 (SEQ ID NO:56). An alignment is given to the known protein (Phospholipid transfer protein precursor (SEQ ID NO:1433)) at the end of the application. One or more alignments to one or more previously published protein sequences are given at the end of the application. A brief description of the relationship of the variant protein according to the present invention to each such aligned protein is as follows:

Comparison report between HUMPHOSLIP_PEA__2_P35 (SEQ ID NO:1333) and PLTP_HUMAN (SEQ ID NO:1433):

1. An isolated chimeric polypeptide encoding for HUMPHOSLIP_PEA__2_P35 (SEQ ID NO:1333), comprising a first amino acid sequence being at least 90% homologous to MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWF corresponding to amino acids 1-109 of PLTP_HUMAN (SEQ ID NO:1433), which also corresponds to amino acids 1-109 of HUMPHOSLIP_PEA__2_P35 (SEQ ID NO:1333), a second amino acid sequence bridging amino acid sequence comprising of L, a third amino acid sequence being at least 90% homologous to KVYDFLSTFITSGMRFLLNQQ corresponding to amino acids 163-183 of PLTP_HUMAN (SEQ ID NO:1433), which also corresponds to amino acids 111-131 of HUMPHOSLIP_PEA__2_P35 (SEQ ID NO:1333), and a fourth amino acid sequence being at least 70%, optionally at least 80%, preferably at least 85%, more preferably at least 90% and most preferably at least 95% homologous to a polypeptide having the sequence VWAATGRRVARVGMLSL (SEQ ID NO: 265) corresponding to amino acids 132-148 of HUMPHOSLIP_PEA__2_P35 (SEQ ID NO:1333), wherein said first amino acid sequence, second amino acid sequence, third amino acid sequence and fourth amino acid sequence are contiguous and in a sequential order.

2. An isolated polypeptide encoding for an edge portion of HUMPHOSLIP_PEA__2_P35 (SEQ ID NO:1333), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise FLK having a structure as follows (numbering according to HUMPHOSLIP_PEA__2_P35 (SEQ ID NO:1333)): a sequence starting from any of amino acid numbers 109-x to 109; and ending at any of amino acid numbers 111+((n-2)-x), in which x varies from 0 to n-2.

3. An isolated polypeptide encoding for a tail of HUMPHOSLIP_PEA__2_P35 (SEQ ID NO:1333), comprising a polypeptide being at least 70%, optionally at least about 80%, preferably at least about 85%, more preferably at least about 90% and most preferably at least about 95% homologous to the sequence VWAATGRRVARVGMLSL (SEQ ID NO: 265) in HUMPHOSLIP_PEA__2_P35 (SEQ ID NO:1333).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMPHOSLIP_PEA__2_P35 (SEQ ID NO:1333) also has the following non-silent SNPs (Single Nucleotide Polymorphisms) as listed in Table 464, (given according to their position(s) on the amino acid sequence, with the alternative amino acid(s) listed; the last column indicates whether the SNP is known or not; the presence of known SNPs in variant protein HUMPHOSLIP_PEA__2_P35 (SEQ ID NO:1333) sequence provides support for the deduced sequence of this variant protein according to the present invention).

TABLE 464

Amino acid mutations

| SNP position(s) on amino acid sequence | Alternative amino acid(s) | Previously known SNP? |
|---|---|---|
| 16 | H -> R | Yes |
| 18 | E -> V | Yes |
| 81 | D -> H | Yes |

The glycosylation sites of variant protein HUMPHOSLIP_PEA__2_P35 (SEQ ID NO:1333), as compared to the known protein Phospholipid transfer protein precursor (SEQ ID NO:1433), are described in Table 465 (given according to their position(s) on the amino acid sequence in the first column; the second column indicates whether the glycosylation site is present in the variant protein; and the last column indicates whether the position is different on the variant protein).

TABLE 465

Glycosylation site(s)

| Position(s) on known amino acid sequence | Present in variant protein? | Position in variant protein? |
|---|---|---|
| 94 | yes | 94 |
| 143 | no | |
| 64 | yes | 64 |
| 245 | no | |
| 398 | no | |
| 117 | no | |

Variant protein HUMPHOSLIP_PEA__2_P35 (SEQ ID NO:1333) is encoded by the following transcript(s): HUMPHOSLIP_PEA__2_T18 (SEQ ID NO:56), for which the sequence(s) is/are given at the end of the application. The coding portion of transcript HUMPHOSLIP_PEA__2_T18 (SEQ ID NO:56) is shown in bold; this coding portion starts at position 276 and ends at position 719. The transcript also has the following SNPs as listed in Table 466 (given according to their position on the nucleotide sequence, with the alternative nucleic acid listed; the last column indicates whether the SNP is known or not; the presence of known SNPs in variant protein HUMPHOSLIP_PEA_2_P35 (SEQ ID NO:1333) sequence provides support for the deduced sequence of this variant protein according to the present invention).

TABLE 466

Nucleic acid SNPs

| SNP position on nucleotide sequence | Alternative nucleic acid | Previously known SNP? |
|---|---|---|
| 174 | G -> T | No |
| 175 | A -> T | No |
| 322 | A -> G | Yes |
| 328 | A -> T | Yes |
| 431 | G -> A | Yes |
| 516 | G -> C | Yes |
| 765 | C -> T | Yes |
| 827 | C -> T | Yes |
| 842 | T -> | No |
| 908 | G -> | No |
| 908 | G -> C | No |
| 937 | A -> | No |
| 967 | C -> | No |
| 1090 | C -> | No |
| 1251 | C -> T | Yes |
| 1311 | G -> | No |
| 1342 | C -> T | Yes |
| 1363 | C -> | No |
| 1433 | T -> A | No |
| 1444 | C -> T | Yes |
| 1479 | G -> C | Yes |
| 1536 | T -> A | Yes |
| 1664 | C -> A | Yes |
| 1683 | C -> T | No |
| 1763 | C -> T | Yes |
| 1779 | A -> G | No |
| 1779 | A -> T | No |
| 1844 | A -> G | Yes |
| 1868 | T -> A | No |
| 1945 | G -> T | Yes |
| 2078 | G -> A | Yes |
| 2107 | G -> T | Yes |
| 2287 | G -> A | Yes |
| 2483 | C -> T | Yes |
| 2539 | G -> T | Yes |
| 2679 | C -> T | Yes |
| 2780 | C -> T | Yes |
| 3095 | A -> G | No |

As noted above, cluster HUMPHOSLIP features 53 segment(s), which were listed in Table 443 above and for which the sequence(s) are given at the end of the application. These segment(s) are portions of nucleic acid sequence(s) which are described herein separately because they are of particular interest. A description of each segment according to the present invention is now provided.

Segment cluster HUMPHOSLIP_PEA_2_node_0 (SEQ ID NO:518) according to the present invention is supported by 150 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 467 below describes the starting and ending position of this segment on each transcript.

TABLE 467

Segment location on transcripts

| Transcript name | Segment starting position | Segment ending position |
|---|---|---|
| HUMPHOSLIP_PEA_2_T6 (SEQ ID NO:51) | 1 | 264 |
| HUMPHOSLIP_PEA_2_T7 (SEQ ID NO:52) | 1 | 264 |
| HUMPHOSLIP_PEA_2_T14 (SEQ ID NO:53) | 1 | 264 |
| HUMPHOSLIP_PEA_2_T16 (SEQ ID NO:54) | 1 | 264 |
| HUMPHOSLIP_PEA_2_T17 (SEQ ID NO:55) | 1 | 264 |
| HUMPHOSLIP_PEA_2_T18 (SEQ ID NO:56) | 1 | 264 |
| HUMPHOSLIP_PEA_2_T19 (SEQ ID NO:57) | 1 | 264 |

Segment cluster HUMPHOSLIP_PEA_2_node_19 (SEQ ID NO:519) according to the present invention is supported by 186 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54) and HUMPHOSLIP_PEA_2_T19 (SEQ ID NO:57). Table 468 below describes the starting and ending position of this segment on each transcript.

TABLE 468

Segment location on transcripts

| Transcript name | Segment starting position | Segment ending position |
|---|---|---|
| HUMPHOSLIP_PEA_2_T6 (SEQ ID NO:51) | 559 | 714 |
| HUMPHOSLIP_PEA_2_T7 (SEQ ID NO:52) | 697 | 852 |
| HUMPHOSLIP_PEA_2_T14 (SEQ ID NO:53) | 605 | 760 |
| HUMPHOSLIP_PEA_2_T16 (SEQ ID NO:54) | 605 | 760 |
| HUMPHOSLIP_PEA_2_T19 (SEQ ID NO:57) | 605 | 760 |

Segment cluster HUMPHOSLIP_PEA_2_node_34 (SEQ ID NO:520) according to the present invention is supported by 191 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 469 below describes the starting and ending position of this segment on each transcript.

TABLE 469

Segment location on transcripts

| Transcript name | Segment starting position | Segment ending position |
|---|---|---|
| HUMPHOSLIP_PEA_2_T6 (SEQ ID NO:51) | 971 | 1111 |
| HUMPHOSLIP_PEA_2_T7 (SEQ ID NO:52) | 1109 | 1249 |
| HUMPHOSLIP_PEA_2_T14 (SEQ ID NO:53) | 1102 | 1242 |
| HUMPHOSLIP_PEA_2_T16 (SEQ ID NO:54) | 1010 | 1150 |
| HUMPHOSLIP_PEA_2_T17 (SEQ ID NO:55) | 732 | 872 |
| HUMPHOSLIP_PEA_2_T18 (SEQ ID NO:56) | 946 | 1086 |
| HUMPHOSLIP_PEA_2_T19 (SEQ ID NO:57) | 1017 | 1157 |

Segment cluster HUMPHOSLIP_PEA_2_node_68 (SEQ ID NO:521) according to the present invention is supported by 131 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 470 below describes the starting and ending position of this segment on each transcript.

TABLE 470

Segment location on transcripts

| Transcript name | Segment starting position | Segment ending position |
|---|---|---|
| HUMPHOSLIP_PEA_2_T6 (SEQ ID NO:51) | 1867 | 2285 |
| HUMPHOSLIP_PEA_2_T7 (SEQ ID NO:52) | 2005 | 2423 |
| HUMPHOSLIP_PEA_2_T14 (SEQ ID NO:53) | 1998 | 2416 |
| HUMPHOSLIP_PEA_2_T16 (SEQ ID NO:54) | 1906 | 2324 |
| HUMPHOSLIP_PEA_2_T17 (SEQ ID NO:55) | 1628 | 2046 |
| HUMPHOSLIP_PEA_2_T18 (SEQ ID NO:56) | 1842 | 2260 |
| HUMPHOSLIP_PEA_2_T19 (SEQ ID NO:57) | 1996 | 2414 |

Segment cluster HUMPHOSLIP_PEA_2_node_70 (SEQ ID NO:522) according to the present invention is supported by 5 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 471 below describes the starting and ending position of this segment on each transcript.

TABLE 471

Segment location on transcripts

| Transcript name | Segment starting position | Segment ending position |
|---|---|---|
| HUMPHOSLIP_PEA_2_T6 (SEQ ID NO:51) | 2298 | 2529 |
| HUMPHOSLIP_PEA_2_T7 (SEQ ID NO:52) | 2436 | 2667 |
| HUMPHOSLIP_PEA_2_T14 (SEQ ID NO:53) | 2429 | 2660 |
| HUMPHOSLIP_PEA_2_T16 (SEQ ID NO:54) | 2337 | 2568 |
| HUMPHOSLIP_PEA_2_T17 (SEQ ID NO:55) | 2059 | 2290 |
| HUMPHOSLIP_PEA_2_T18 (SEQ ID NO:56) | 2273 | 2504 |
| HUMPHOSLIP_PEA_2_T19 (SEQ ID NO:57) | 2427 | 2658 |

Segment cluster HUMPHOSLIP_PEA_2_node_75 (SEQ ID NO:523) according to the present invention is supported by 14 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54) HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 472 below describes the starting and ending position of this segment on each transcript.

TABLE 472

Segment location on transcripts

| Transcript name | Segment starting position | Segment ending position |
|---|---|---|
| HUMPHOSLIP_PEA_2_T6 (SEQ ID NO:51) | 2846 | 3125 |
| HUMPHOSLIP_PEA_2_T7 (SEQ ID NO:52) | 2984 | 3263 |
| HUMPHOSLIP_PEA_2_T14 (SEQ ID NO:53) | 2977 | 3256 |
| HUMPHOSLIP_PEA_2_T16 (SEQ ID NO:54) | 2885 | 3164 |
| HUMPHOSLIP_PEA_2_T17 (SEQ ID NO:55) | 2607 | 2886 |
| HUMPHOSLIP_PEA_2_T18 (SEQ ID NO:56) | 2821 | 3100 |
| HUMPHOSLIP_PEA_2_T19 (SEQ ID NO:57) | 2975 | 3254 |

According to an optional embodiment of the present invention, short segments related to the above cluster are also provided. These segments are up to about 120 bp in length, and so are included in a separate description.

Segment cluster HUMPHOSLIP_PEA_2_node_2 (SEQ ID NO:524) according to the present invention is supported by 159 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 473 below describes the starting and ending position of this segment on each transcript.

TABLE 473

Segment location on transcripts

| Transcript name | Segment starting position | Segment ending position |
|---|---|---|
| HUMPHOSLIP_PEA_2_T6 (SEQ ID NO:51) | 265 | 337 |
| HUMPHOSLIP_PEA_2_T7 (SEQ ID NO:52) | 265 | 337 |
| HUMPHOSLIP_PEA_2_T14 (SEQ ID NO:53) | 265 | 337 |
| HUMPHOSLIP_PEA_2_T16 (SEQ ID NO:54) | 265 | 337 |
| HUMPHOSLIP_PEA_2_T17 (SEQ ID NO:55) | 265 | 337 |
| HUMPHOSLIP_PEA_2_T18 (SEQ ID NO:56) | 265 | 337 |
| HUMPHOSLIP_PEA_2_T19 (SEQ ID NO:57) | 265 | 337 |

Segment cluster HUMPHOSLIP_PEA_2_node_3 (SEQ ID NO:525) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 474 below describes the starting and ending position of this segment on each transcript.

TABLE 474

Segment location on transcripts

| Transcript name | Segment starting position | Segment ending position |
|---|---|---|
| HUMPHOSLIP_PEA_2_T7 (SEQ ID NO:52) | 338 | 355 |
| HUMPHOSLIP_PEA_2_T14 (SEQ ID NO:53) | 338 | 355 |
| HUMPHOSLIP_PEA_2_T16 (SEQ ID NO:54) | 338 | 355 |
| HUMPHOSLIP_PEA_2_T17 (SEQ ID NO:55) | 338 | 355 |

TABLE 474-continued

Segment location on transcripts

| Transcript name | Segment starting position | Segment ending position |
|---|---|---|
| HUMPHOSLIP_PEA_2_T18 (SEQ ID NO:56) | 338 | 355 |
| HUMPHOSLIP_PEA_2_T19 (SEQ ID NO:57) | 338 | 355 |

Segment cluster HUMPHOSLIP_PEA_2_node_4 (SEQ ID NO:526) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 475 below describes the starting and ending position of this segment on each transcript.

TABLE 475

Segment location on transcripts

| Transcript name | Segment starting position | Segment ending position |
|---|---|---|
| HUMPHOSLIP_PEA_2_T7 (SEQ ID NO:52) | 356 | 375 |
| HUMPHOSLIP_PEA_2_T14 (SEQ ID NO:53) | 356 | 375 |
| HUMPHOSLIP_PEA_2_T16 (SEQ ID NO:54) | 356 | 375 |
| HUMPHOSLIP_PEA_2_T17 (SEQ ID NO:55) | 356 | 375 |
| HUMPHOSLIP_PEA_2_T18 (SEQ ID NO:56) | 356 | 375 |
| HUMPHOSLIP_PEA_2_T19 (SEQ ID NO:57) | 356 | 375 |

Segment cluster HUMPHOSLIP_PEA_2_node_6 (SEQ ID NO:527) according to the present invention can be found in the following transcript(s): HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 476 below describes the starting and ending position of this segment on each transcript.

TABLE 476

Segment location on transcripts

| Transcript name | Segment starting position | Segment ending position |
|---|---|---|
| HUMPHOSLIP_PEA_2_T7 (SEQ ID NO:52) | 376 | 383 |
| HUMPHOSLIP_PEA_2_T14 (SEQ ID NO:53) | 376 | 383 |
| HUMPHOSLIP_PEA_2_T16 (SEQ ID NO:54) | 376 | 383 |
| HUMPHOSLIP_PEA_2_T17 (SEQ ID NO:55) | 376 | 383 |
| HUMPHOSLIP_PEA_2_T18 (SEQ ID NO:56) | 376 | 383 |
| HUMPHOSLIP_PEA_2_T19 (SEQ ID NO:57) | 376 | 383 |

Segment cluster HUMPHOSLIP_PEA_2_node. 7 (SEQ ID NO:528) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 477 below describes the starting and ending position of this segment on each transcript.

TABLE 477

Segment location on transcripts

| Transcript name | Segment starting position | Segment ending position |
|---|---|---|
| HUMPHOSLIP_PEA_2_T6 (SEQ ID NO:51) | 338 | 343 |
| HUMPHOSLIP_PEA_2_T7 (SEQ ID NO:52) | 384 | 389 |
| HUMPHOSLIP_PEA_2_T14 (SEQ ID NO:53) | 384 | 389 |
| HUMPHOSLIP_PEA_2_T16 (SEQ ID NO:54) | 384 | 389 |
| HUMPHOSLIP_PEA_2_T17 (SEQ ID NO:55) | 384 | 389 |
| HUMPHOSLIP_PEA_2_T18 (SEQ ID NO:56) | 384 | 389 |
| HUMPHOSLIP_PEA_2_T19 (SEQ ID NO:57) | 384 | 389 |

Segment cluster HUMPHOSLIP_PEA_2_node_8 (SEQ ID NO:529) according to the present invention is supported by 171 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 478 below describes the starting and ending position of this segment on each transcript.

TABLE 478

Segment location on transcripts

| Transcript name | Segment starting position | Segment ending position |
|---|---|---|
| HUMPHOSLIP_PEA_2_T6 (SEQ ID NO:51) | 344 | 378 |
| HUMPHOSLIP_PEA_2_T7 (SEQ ID NO:52) | 390 | 424 |
| HUMPHOSLIP_PEA_2_T14 (SEQ ID NO:53) | 390 | 424 |
| HUMPHOSLIP_PEA_2_T16 (SEQ ID NO:54) | 390 | 424 |
| HUMPHOSLIP_PEA_2_T17 (SEQ ID NO:55) | 390 | 424 |
| HUMPHOSLIP_PEA_2_T18 (SEQ ID NO:56) | 390 | 424 |
| HUMPHOSLIP_PEA_2_T19 (SEQ ID NO:57) | 390 | 424 |

Segment cluster HUMPHOSLIP_PEA_2_node_9 (SEQ ID NO:530) according to the present invention is supported by 168 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 479 below describes the starting and ending position of this segment on each transcript.

TABLE 479

Segment location on transcripts

| Transcript name | Segment starting position | Segment ending position |
|---|---|---|
| HUMPHOSLIP_PEA_2_T6 (SEQ ID NO:51) | 379 | 429 |
| HUMPHOSLIP_PEA_2_T7 (SEQ ID NO:52) | 425 | 475 |

TABLE 479-continued

Segment location on transcripts

| Transcript name | Segment starting position | Segment ending position |
|---|---|---|
| HUMPHOSLIP_PEA_2_T14 (SEQ ID NO:53) | 425 | 475 |
| HUMPHOSLIP_PEA_2_T16 (SEQ ID NO:54) | 425 | 475 |
| HUMPHOSLIP_PEA_2_T17 (SEQ ID NO:55) | 425 | 475 |
| HUMPHOSLIP_PEA_2_T18 (SEQ ID NO:56) | 425 | 475 |
| HUMPHOSLIP_PEA_2_T19 (SEQ ID NO:57) | 425 | 475 |

Segment cluster HUMPHOSLIP_PEA_2_node_14 (SEQ ID NO:531) according to the present invention is supported by 6 libraries. The number of libraries was determined as previously described. This segment can be found in the following transcript(s): HUMPHOSLIP_PEA_2_T7 (SEQ ID NO:52). Table 480 below describes the starting and ending position of this segment on each transcript.

TABLE 480

Segment location on transcripts

| Transcript name | Segment starting position | Segment ending position |
|---|---|---|
| HUMPHOSLIP_PEA_2_T7 (SEQ ID NO:52) | 476 | 567 |

Segment cluster HUMPHOSLIP_PEA_2_node_15 (SEQ ID NO:532) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 481 below describes the starting and ending position of this segment on each transcript.

TABLE 481

Segment location on transcripts

| Transcript name | Segment starting position | Segment ending position |
|---|---|---|
| HUMPHOSLIP_PEA_2_T6 (SEQ ID NO:51) | 430 | 445 |
| HUMPHOSLIP_PEA_2_T7 (SEQ ID NO:52) | 568 | 583 |
| HUMPHOSLIP_PEA_2_T14 (SEQ ID NO:53) | 476 | 491 |
| HUMPHOSLIP_PEA_2_T16 (SEQ ID NO:54) | 476 | 491 |
| HUMPHOSLIP_PEA_2_T18 (SEQ ID NO:56) | 476 | 491 |
| HUMPHOSLIP_PEA_2_T19 (SEQ ID NO:57) | 476 | 491 |

Segment cluster HUMPHOSLIP_PEA_2_node_16 (SEQ ID NO:533) according to the present invention is supported by 179 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 482 below describes the starting and ending position of this segment on each transcript.

TABLE 482

Segment location on transcripts

| Transcript name | Segment starting position | Segment ending position |
|---|---|---|
| HUMPHOSLIP_PEA_2_T6 (SEQ ID NO:51) | 446 | 534 |
| HUMPHOSLIP_PEA_2_T7 (SEQ ID NO:52) | 584 | 672 |
| HUMPHOSLIP_PEA_2_T14 (SEQ ID NO:53) | 492 | 580 |
| HUMPHOSLIP_PEA_2_T16 (SEQ ID NO:54) | 492 | 580 |
| HUMPHOSLIP_PEA_2_T18 (SEQ ID NO:56) | 492 | 580 |
| HUMPHOSLIP_PEA_2_T19 (SEQ ID NO:57) | 492 | 580 |

Segment cluster HUMPHOSLIP_PEA_2_node_17 (SEQ ID NO:534) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T18 (SEQ ID NO:56) and HUMPHOSLIP_PEA_2_T19 (SEQ ID NO:57). Table 483 below describes the starting and ending position of this segment on each transcript.

TABLE 483

Segment location on transcripts

| Transcript name | Segment starting position | Segment ending position |
|---|---|---|
| HUMPHOSLIP_PEA_2_T6 (SEQ ID NO:51) | 535 | 558 |
| HUMPHOSLIP_PEA_2_T7 (SEQ ID NO:52) | 673 | 696 |
| HUMPHOSLIP_PEA_2_T14 (SEQ ID NO:53) | 581 | 604 |
| HUMPHOSLIP_PEA_2_T16 (SEQ ID NO:54) | 581 | 604 |
| HUMPHOSLIP_PEA_2_T18 (SEQ ID NO:56) | 581 | 604 |
| HUMPHOSLIP_PEA_2_T19 (SEQ ID NO:57) | 581 | 604 |

Segment cluster HUMPHOSLIP_PEA_2_node_23 (SEQ ID NO:535) according to the present invention is supported by 168 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 484 below describes the starting and ending position of this segment on each transcript.

TABLE 484

Segment location on transcripts

| Transcript name | Segment starting position | Segment ending position |
|---|---|---|
| HUMPHOSLIP_PEA_2_T6 (SEQ ID NO:51) | 715 | 766 |
| HUMPHOSLIP_PEA_2_T7 (SEQ ID NO:52) | 853 | 904 |
| HUMPHOSLIP_PEA_2_T14 (SEQ ID NO:53) | 761 | 812 |
| HUMPHOSLIP_PEA_2_T16 (SEQ ID NO:54) | 761 | 812 |
| HUMPHOSLIP_PEA_2_T17 (SEQ ID NO:55) | 476 | 527 |
| HUMPHOSLIP_PEA_2_T18 (SEQ ID NO:56) | 605 | 656 |
| HUMPHOSLIP_PEA_2_T19 (SEQ ID NO:57) | 761 | 812 |

Segment cluster HUMPHOSLIP_PEA_2_node_24 (SEQ ID NO:536) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 485 below describes the starting and ending position of this segment on each transcript.

TABLE 485

Segment location on transcripts

| Transcript name | Segment starting position | Segment ending position |
|---|---|---|
| HUMPHOSLIP_PEA_2_T6 (SEQ ID NO:51) | 767 | 778 |
| HUMPHOSLIP_PEA_2_T7 (SEQ ID NO:52) | 905 | 916 |
| HUMPHOSLIP_PEA_2_T14 (SEQ ID NO:53) | 813 | 824 |
| HUMPHOSLIP_PEA_2_T16 (SEQ ID NO:54) | 813 | 824 |
| HUMPHOSLIP_PEA_2_T17 (SEQ ID NO:55) | 528 | 539 |
| HUMPHOSLIP_PEA_2_T18 (SEQ ID NO:56) | 657 | 668 |
| HUMPHOSLIP_PEA_2_T19 (SEQ ID NO:57) | 813 | 824 |

Segment cluster HUMPHOSLIP_PEA_2_node_25 (SEQ ID NO:537) according to the present invention is supported by 5 libraries. The number of libraries was determined as previously described. This segment can be found in the following transcript(s): HUMPHOSLIP_PEA_2_T14 (SEQ ID NO:53) and HUMPHOSLIP_PEA_2_T18 (SEQ ID NO:56). Table 486 below describes the starting and ending position of this segment on each transcript.

TABLE 486

Segment location on transcripts

| Transcript name | Segment starting position | Segment ending position |
|---|---|---|
| HUMPHOSLIP_PEA_2_T14 (SEQ ID NO:53) | 825 | 909 |
| HUMPHOSLIP_PEA_2_T18 (SEQ ID NO:56) | 669 | 753 |

Segment cluster HUMPHOSLIP_PEA_2_node_26 (SEQ ID NO:538) according to the present invention is supported by 163 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 487 below describes the starting and ending position of this segment on each transcript.

TABLE 487

Segment location on transcripts

| Transcript name | Segment starting position | Segment ending position |
|---|---|---|
| HUMPHOSLIP_PEA_2_T6 (SEQ ID NO:51) | 779 | 842 |
| HUMPHOSLIP_PEA_2_T7 (SEQ ID NO:52) | 917 | 980 |

TABLE 487-continued

Segment location on transcripts

| Transcript name | Segment starting position | Segment ending position |
|---|---|---|
| HUMPHOSLIP_PEA_2_T14 (SEQ ID NO:53) | 910 | 973 |
| HUMPHOSLIP_PEA_2_T16 (SEQ ID NO:54) | 825 | 888 |
| HUMPHOSLIP_PEA_2_T17 (SEQ ID NO:55) | 540 | 603 |
| HUMPHOSLIP_PEA_2_T18 (SEQ ID NO:56) | 754 | 817 |
| HUMPHOSLIP_PEA_2_T19 (SEQ ID NO:57) | 825 | 888 |

Segment cluster HUMPHOSLIP_PEA_2_node_29 (SEQ ID NO:539) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 488 below describes the starting and ending position of this segment on each transcript.

TABLE 488

Segment location on transcripts

| Transcript name | Segment starting position | Segment ending position |
|---|---|---|
| HUMPHOSLIP_PEA_2_T6 (SEQ ID NO:51) | 843 | 849 |
| HUMPHOSLIP_PEA_2_T7 (SEQ ID NO:52) | 981 | 987 |
| HUMPHOSLIP_PEA_2_T14 (SEQ ID NO:53) | 974 | 980 |
| HUMPHOSLIP_PEA_2_T17 (SEQ ID NO:55) | 604 | 610 |
| HUMPHOSLIP_PEA_2_T18 (SEQ ID NO:56) | 818 | 824 |
| HUMPHOSLIP_PEA_2_T19 (SEQ ID NO:57) | 889 | 895 |

Segment cluster HUMPHOSLIP_PEA_2_node_30 (SEQ ID NO:540) according to the present invention is supported by 181 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 489 below describes the starting and ending position of this segment on each transcript.

TABLE 489

Segment location on transcripts

| Transcript name | Segment starting position | Segment ending position |
|---|---|---|
| HUMPHOSLIP_PEA_2_T6 (SEQ ID NO:51) | 850 | 934 |
| HUMPHOSLIP_PEA_2_T7 (SEQ ID NO:52) | 988 | 1072 |
| HUMPHOSLIP_PEA_2_T14 (SEQ ID NO:53) | 981 | 1065 |
| HUMPHOSLIP_PEA_2_T16 (SEQ ID NO:54) | 889 | 973 |
| HUMPHOSLIP_PEA_2_T17 (SEQ ID NO:55) | 611 | 695 |
| HUMPHOSLIP_PEA_2_T18 (SEQ ID NO:56) | 825 | 909 |
| HUMPHOSLIP_PEA_2_T19 (SEQ ID NO:57) | 896 | 980 |

Segment cluster HUMPHOSLIP_PEA_2_node_33 (SEQ ID NO:541) according to the present invention is supported by 173 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 490 below describes the starting and ending position of this segment on each transcript.

TABLE 490

Segment location on transcripts

| Transcript name | Segment starting position | Segment ending position |
| --- | --- | --- |
| HUMPHOSLIP_PEA_2_T6 (SEQ ID NO:51) | 935 | 970 |
| HUMPHOSLIP_PEA_2_T7 (SEQ ID NO:52) | 1073 | 1108 |
| HUMPHOSLIP_PEA_2_T14 (SEQ ID NO:53) | 1066 | 1101 |
| HUMPHOSLIP_PEA_2_T16 (SEQ ID NO:54) | 974 | 1009 |
| HUMPHOSLIP_PEA_2_T17 (SEQ ID NO:55) | 696 | 731 |
| HUMPHOSLIP_PEA_2_T18 (SEQ ID NO:56) | 910 | 945 |
| HUMPHOSLIP_PEA_2_T19 (SEQ ID NO:57) | 981 | 1016 |

Segment cluster HUMPHOSLIP_PEA_2_node_36 (SEQ ID NO:542) according to the present invention is supported by 163 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 491 below describes the starting and ending position of this segment on each transcript.

TABLE 491

Segment location on transcripts

| Transcript name | Segment starting position | Segment ending position |
| --- | --- | --- |
| HUMPHOSLIP_PEA_2_T6 (SEQ ID NO:51) | 1112 | 1156 |
| HUMPHOSLIP_PEA_2_T7 (SEQ ID NO:52) | 1250 | 1294 |
| HUMPHOSLIP_PEA_2_T14 (SEQ ID NO:53) | 1243 | 1287 |
| HUMPHOSLIP_PEA_2_T16 (SEQ ID NO:54) | 1151 | 1195 |
| HUMPHOSLIP_PEA_2_T17 (SEQ ID NO:55) | 873 | 917 |
| HUMPHOSLIP_PEA_2_T18 (SEQ ID NO:56) | 1087 | 1131 |
| HUMPHOSLIP_PEA_2_T19 (SEQ ID NO:57) | 1158 | 1202 |

Segment cluster HUMPHOSLIP_PEA_2_node_37 (SEQ ID NO:543) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 492 below describes the starting and ending position of this segment on each transcript.

TABLE 492

Segment location on transcripts

| Transcript name | Segment starting position | Segment ending position |
| --- | --- | --- |
| HUMPHOSLIP_PEA_2_T6 (SEQ ID NO:51) | 1157 | 1171 |
| HUMPHOSLIP_PEA_2_T7 (SEQ ID NO:52) | 1295 | 1309 |
| HUMPHOSLIP_PEA_2_T14 (SEQ ID NO:53) | 1288 | 1302 |
| HUMPHOSLIP_PEA_2_T16 (SEQ ID NO:54) | 1196 | 1210 |
| HUMPHOSLIP_PEA_2_T17 (SEQ ID NO:55) | 918 | 932 |
| HUMPHOSLIP_PEA_2_T18 (SEQ ID NO:56) | 1132 | 1146 |
| HUMPHOSLIP_PEA_2_T19 (SEQ ID NO:57) | 1248 | 1217 |

Segment cluster HUMPHOSLIP_PEA_2_node_39 (SEQ ID NO:544) according to the present invention is supported by 166 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 493 below describes the starting and ending position of this segment on each transcript.

TABLE 493

Segment location on transcripts

| Transcript name | Segment starting position | Segment ending position |
| --- | --- | --- |
| HUMPHOSLIP_PEA_2_T6 (SEQ ID NO:51) | 1172 | 1201 |
| HUMPHOSLIP_PEA_2_T7 (SEQ ID NO:52) | 1310 | 1339 |
| HUMPHOSLIP_PEA_2_T14 (SEQ ID NO:53) | 1303 | 1332 |
| HUMPHOSLIP_PEA_2_T16 (SEQ ID NO:54) | 1211 | 1240 |
| HUMPHOSLIP_PEA_2_T17 (SEQ ID NO:55) | 933 | 962 |
| HUMPHOSLIP_PEA_2_T18 (SEQ ID NO:56) | 1147 | 1176 |
| HUMPHOSLIP_PEA_2_T19 (SEQ ID NO:57) | 1218 | 1247 |

Segment cluster HUMPHOSLIP_PEA_2_node_40 (SEQ ID NO:545) according to the present invention is supported by 199 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 494 below describes the starting and ending position of this segment on each transcript.

TABLE 494

Segment location on transcripts

| Transcript name | Segment starting position | Segment ending position |
| --- | --- | --- |
| HUMPHOSLIP_PEA_2_T6 (SEQ ID NO:51) | 1202 | 1288 |
| HUMPHOSLIP_PEA_2_T7 (SEQ ID NO:52) | 1340 | 1426 |
| HUMPHOSLIP_PEA_2_T14 (SEQ ID NO:53) | 1333 | 1419 |
| HUMPHOSLIP_PEA_2_T16 (SEQ ID NO:54) | 1241 | 1327 |

TABLE 494-continued

Segment location on transcripts

| Transcript name | Segment starting position | Segment ending position |
|---|---|---|
| HUMPHOSLIP_PEA_2_T17 (SEQ ID NO:55) | 963 | 1049 |
| HUMPHOSLIP_PEA_2_T18 (SEQ ID NO:56) | 1177 | 1263 |
| HUMPHOSLIP_PEA_2_T19 (SEQ ID NO:57) | 1248 | 1334 |

Segment cluster HUMPHOSLIP_PEA_2_node_41 (SEQ ID NO:546) according to the present invention is supported by 186 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 495 below describes the starting and ending position of this segment on each transcript.

TABLE 495

Segment location on transcripts

| Transcript name | Segment starting position | Segment ending position |
|---|---|---|
| HUMPHOSLIP_PEA_2_T6 (SEQ ID NO:51) | 1289 | 1318 |
| HUMPHOSLIP_PEA_2_T7 (SEQ ID NO:52) | 1427 | 1456 |
| HUMPHOSLIP_PEA_2_T14 (SEQ ID NO:53) | 1420 | 1449 |
| HUMPHOSLIP_PEA_2_T16 (SEQ ID NO:54) | 1328 | 1357 |
| HUMPHOSLIP_PEA_2_T17 (SEQ ID NO:55) | 1050 | 1079 |
| HUMPHOSLIP_PEA_2_T18 (SEQ ID NO:56) | 1264 | 1293 |
| HUMPHOSLIP_PEA_2_T19 (SEQ ID NO:57) | 1335 | 1364 |

Segment cluster HUMPHOSLIP_PEA_2_node_42 (SEQ ID NO:547) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 496 below describes the starting and ending position of this segment on each transcript.

TABLE 496

Segment location on transcripts

| Transcript name | Segment starting position | Segment ending position |
|---|---|---|
| HUMPHOSLIP_PEA_2_T6 (SEQ ID NO:51) | 1319 | 1336 |
| HUMPHOSLIP_PEA_2_T7 (SEQ ID NO:52) | 1457 | 1474 |
| HUMPHOSLIP_PEA_2_T14 (SEQ ID NO:53) | 1450 | 1467 |
| HUMPHOSLIP_PEA_2_T16 (SEQ ID NO:54) | 1358 | 1375 |
| HUMPHOSLIP_PEA_2_T17 (SEQ ID NO:55) | 1080 | 1097 |
| HUMPHOSLIP_PEA_2_T18 (SEQ ID NO:56) | 1294 | 1311 |
| HUMPHOSLIP_PEA_2_T19 (SEQ ID NO:57) | 1365 | 1382 |

Segment cluster HUMPHOSLIP_PEA_2_node_44 (SEQ ID NO:548) according to the present invention is supported by 185 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 497 below describes the starting and ending position of this segment on each transcript.

TABLE 497

Segment location on transcripts

| Transcript name | Segment starting position | Segment ending position |
|---|---|---|
| HUMPHOSLIP_PEA_2_T6 (SEQ ID NO:51) | 1337 | 1363 |
| HUMPHOSLIP_PEA_2_T7 (SEQ ID NO:52) | 1475 | 1501 |
| HUMPHOSLIP_PEA_2_T14 (SEQ ID NO:53) | 1468 | 1494 |
| HUMPHOSLIP_PEA_2_T16 (SEQ ID NO:54) | 1376 | 1402 |
| HUMPHOSLIP_PEA_2_T17 (SEQ ID NO:55) | 1098 | 1124 |
| HUMPHOSLIP_PEA_2_T18 (SEQ ID NO:56) | 1312 | 1338 |
| HUMPHOSLIP_PEA_2_T19 (SEQ ID NO:57) | 1383 | 1409 |

Segment cluster HUMPHOSLIP_PEA_2_node_45 (SEQ ID NO:549) according to the present invention is supported by 197 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 498 below describes the starting and ending position of this segment on each transcript.

TABLE 498

Segment location on transcripts

| Transcript name | Segment starting position | Segment ending position |
|---|---|---|
| HUMPHOSLIP_PEA_2_T6 (SEQ ID NO:51) | 1364 | 1404 |
| HUMPHOSLIP_PEA_2_T7 (SEQ ID NO:52) | 1502 | 1542 |
| HUMPHOSLIP_PEA_2_T14 (SEQ ID NO:53) | 1495 | 1535 |
| HUMPHOSLIP_PEA_2_T16 (SEQ ID NO:54) | 1403 | 1443 |
| HUMPHOSLIP_PEA_2_T17 (SEQ ID NO:55) | 1125 | 1165 |
| HUMPHOSLIP_PEA_2_T18 (SEQ ID NO:56) | 1339 | 1379 |
| HUMPHOSLIP_PEA_2_T19 (SEQ ID NO:57) | 1410 | 1450 |

Segment cluster HUMPHOSLIP_PEA_2_node_47 (SEQ ID NO:550) according to the present invention is supported by 223 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54) HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 499 below describes the starting and ending position of this segment on each transcript.

TABLE 499

Segment location on transcripts

| Transcript name | Segment starting position | Segment ending position |
|---|---|---|
| HUMPHOSLIP_PEA_2_T6 (SEQ ID NO:51) | 1405 | 1447 |
| HUMPHOSLIP_PEA_2_T7 (SEQ ID NO:52) | 1543 | 1585 |
| HUMPHOSLIP_PEA_2_T14 (SEQ ID NO:53) | 1536 | 1578 |
| HUMPHOSLIP_PEA_2_T16 (SEQ ID NO:54) | 1444 | 1486 |
| HUMPHOSLIP_PEA_2_T17 (SEQ ID NO:55) | 1166 | 1208 |
| HUMPHOSLIP_PEA_2_T18 (SEQ ID NO:56) | 1380 | 1422 |
| HUMPHOSLIP_PEA_2_T19 (SEQ ID NO:57) | 1451 | 1493 |

Segment cluster HUMPHOSLIP_PEA_2_node_51 (SEQ ID NO:551) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP PEA_2_T17 (SEQ ID NO:55), HUMPHOSLIP_PEA_2_T18 (SEQ ID NO:56) and HUMPHOSLIP_PEA_2_T19 (SEQ ID NO:57). Table 500 below describes the starting and ending position of this segment on each transcript.

TABLE 500

Segment location on transcripts

| Transcript name | Segment starting position | Segment ending position |
|---|---|---|
| HUMPHOSLIP_PEA_2_T6 (SEQ ID NO:51) | 1448 | 1462 |
| HUMPHOSLIP_PEA_2_T7 (SEQ ID NO:52) | 1586 | 1600 |
| HUMPHOSLIP_PEA_2_T14 (SEQ ID NO:53) | 1579 | 1593 |
| HUMPHOSLIP_PEA_2_T16 (SEQ ID NO:54) | 1487 | 1501 |
| HUMPHOSLIP_PEA_2_T17 (SEQ ID NO:55) | 1209 | 1223 |
| HUMPHOSLIP_PEA_2_T18 (SEQ ID NO:56) | 1423 | 1437 |
| HUMPHOSLIP_PEA_2_T19 (SEQ ID NO:57) | 1494 | 1508 |

Segment cluster HUMPHOSLIP_PEA_2_node_52 (SEQ ID NO:552) according to the present invention is supported by 235 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 501 below describes the starting and ending position of this segment on each transcript.

TABLE 501

Segment location on transcripts

| Transcript name | Segment starting position | Segment ending position |
|---|---|---|
| HUMPHOSLIP_PEA_2_T6 (SEQ ID NO:51) | 1463 | 1511 |
| HUMPHOSLIP_PEA_2_T7 (SEQ ID NO:52) | 1601 | 1649 |
| HUMPHOSLIP_PEA_2_T14 (SEQ ID NO:53) | 1594 | 1642 |
| HUMPHOSLIP_PEA_2_T16 (SEQ ID NO:54) | 1502 | 1550 |
| HUMPHOSLIP_PEA_2_T17 (SEQ ID NO:55) | 1224 | 1272 |
| HUMPHOSLIP_PEA_2_T18 (SEQ ID NO:56) | 1438 | 1486 |
| HUMPHOSLIP_PEA_2_T19 (SEQ ID NO:57) | 1509 | 1557 |

Segment cluster HUMPHOSLIP_PEA_2_node_53 (SEQ ID NO:553) according to the present invention is supported by 5 libraries. The number of libraries was determined as previously described. This segment can be found in the following transcript(s): HUMPHOSLIP_PEA_2_T19 (SEQ ID NO:57). Table 502 below describes the starting and ending position of this segment on each transcript.

TABLE 502

Segment location on transcripts

| Transcript name | Segment starting position | Segment ending position |
|---|---|---|
| HUMPHOSLIP_PEA_2_T19 (SEQ ID NO:57) | 1558 | 1640 |

Segment cluster HUMPHOSLIP_PEA_2_node_54 (SEQ ID NO:554) according to the present invention is supported by 236 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54) HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 503 below describes the starting and ending position of this segment on each transcript.

TABLE 503

Segment location on transcripts

| Transcript name | Segment starting position | Segment ending position |
|---|---|---|
| HUMPHOSLIP_PEA_2_T6 (SEQ ID NO:51) | 1512 | 1552 |
| HUMPHOSLIP_PEA_2_T7 (SEQ ID NO:52) | 1650 | 1690 |
| HUMPHOSLIP_PEA_2_T14 (SEQ ID NO:53) | 1643 | 1683 |
| HUMPHOSLIP_PEA_2_T16 (SEQ ID NO:54) | 1551 | 1591 |
| HUMPHOSLIP_PEA_2_T17 (SEQ ID NO:55) | 1273 | 1313 |
| HUMPHOSLIP_PEA_2_T18 (SEQ ID NO:56) | 1487 | 1527 |
| HUMPHOSLIP_PEA_2_T19 (SEQ ID NO:57) | 1641 | 1681 |

Segment cluster HUMPHOSLIP_PEA_2_node_55 (SEQ ID NO:555) according to the present invention is supported by 232 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 504 below describes the starting and ending position of this segment on each transcript.

TABLE 504

Segment location on transcripts

| Transcript name | Segment starting position | Segment ending position |
|---|---|---|
| HUMPHOSLIP_PEA_2_T6 (SEQ ID NO:51) | 1553 | 1588 |
| HUMPHOSLIP_PEA_2_T7 (SEQ ID NO:52) | 1691 | 1726 |
| HUMPHOSLIP_PEA_2_T14 (SEQ ID NO:53) | 1684 | 1719 |
| HUMPHOSLIP_PEA_2_T16 (SEQ ID NO:54) | 1592 | 1627 |
| HUMPHOSLIP_PEA_2_T17 (SEQ ID NO:55) | 1314 | 1349 |
| HUMPHOSLIP_PEA_2_T18 (SEQ ID NO:56) | 1528 | 1563 |
| HUMPHOSLIP_PEA_2_T19 (SEQ ID NO:57) | 1682 | 1717 |

Segment cluster HUMPHOSLIP_PEA_2_node_58 (SEQ ID NO:556) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 505 below describes the starting and ending position of this segment on each transcript.

TABLE 505

Segment location on transcripts

| Transcript name | Segment starting position | Segment ending position |
|---|---|---|
| HUMPHOSLIP_PEA_2_T6 (SEQ ID NO:51) | 1589 | 1612 |
| HUMPHOSLIP_PEA_2_T7 (SEQ ID NO:52) | 1727 | 1750 |
| HUMPHOSLIP_PEA_2_T14 (SEQ ID NO:53) | 1720 | 1743 |
| HUMPHOSLIP_PEA_2_T16 (SEQ ID NO:54) | 1628 | 1651 |
| HUMPHOSLIP_PEA_2_T17 (SEQ ID NO:55) | 1350 | 1373 |
| HUMPHOSLIP_PEA_2_T18 (SEQ ID NO:56) | 1564 | 1587 |
| HUMPHOSLIP_PEA_2_T19 (SEQ ID NO:57) | 1718 | 1741 |

Segment cluster HUMPHOSLIP_PEA_2_node_59 (SEQ ID NO:557) according to the present invention is supported by 230 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 506 below describes the starting and ending position of this segment on each transcript.

TABLE 506

Segment location on transcripts

| Transcript name | Segment starting position | Segment ending position |
|---|---|---|
| HUMPHOSLIP_PEA_2_T6 (SEQ ID NO:51) | 1613 | 1648 |
| HUMPHOSLIP_PEA_2_T7 (SEQ ID NO:52) | 1751 | 1786 |
| HUMPHOSLIP_PEA_2_T14 (SEQ ID NO:53) | 1744 | 1779 |
| HUMPHOSLIP_PEA_2_T16 (SEQ ID NO:54) | 1652 | 1687 |
| HUMPHOSLIP_PEA_2_T17 (SEQ ID NO:55) | 1374 | 1409 |
| HUMPHOSLIP_PEA_2_T18 (SEQ ID NO:56) | 1588 | 1623 |
| HUMPHOSLIP_PEA_2_T19 (SEQ ID NO:57) | 1742 | 1777 |

Segment cluster HUMPHOSLIP_PEA_2_node_60 (SEQ ID NO:558) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 507 below describes the starting and ending position of this segment on each transcript.

TABLE 507

Segment location on transcripts

| Transcript name | Segment starting position | Segment ending position |
|---|---|---|
| HUMPHOSLIP_PEA_2_T6 (SEQ ID NO:51) | 1649 | 1671 |
| HUMPHOSLIP_PEA_2_T7 (SEQ ID NO:52) | 1787 | 1809 |
| HUMPHOSLIP_PEA_2_T14 (SEQ ID NO:53) | 1780 | 1802 |
| HUMPHOSLIP_PEA_2_T16 (SEQ ID NO:54) | 1688 | 1710 |
| HUMPHOSLIP_PEA_2_T17 (SEQ ID NO:55) | 1410 | 1432 |
| HUMPHOSLIP_PEA_2_T18 (SEQ ID NO:56) | 1624 | 1646 |
| HUMPHOSLIP_PEA_2_T19 (SEQ ID NO:57) | 1778 | 1800 |

Segment cluster HUMPHOSLIP_PEA_2_node_61 (SEQ ID NO:559) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 508 below describes the starting and ending position of this segment on each transcript.

TABLE 508

Segment location on transcripts

| Transcript name | Segment starting position | Segment ending position |
|---|---|---|
| HUMPHOSLIP_PEA_2_T6 (SEQ ID NO:51) | 1672 | 1680 |
| HUMPHOSLIP_PEA_2_T7 (SEQ ID NO:52) | 1810 | 1818 |
| HUMPHOSLIP_PEA_2_T14 (SEQ ID NO:53) | 1803 | 1811 |
| HUMPHOSLIP_PEA_2_T16 (SEQ ID NO:54) | 1711 | 1719 |
| HUMPHOSLIP_PEA_2_T17 (SEQ ID NO:55) | 1433 | 1441 |
| HUMPHOSLIP_PEA_2_T18 (SEQ ID NO:56) | 1647 | 1655 |
| HUMPHOSLIP_PEA_2_T19 (SEQ ID NO:57) | 1801 | 1809 |

Segment cluster HUMPHOSLIP_PEA_2_node_62 (SEQ ID NO:560) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 509 below describes the starting and ending position of this segment on each transcript.

TABLE 509

Segment location on transcripts

| Transcript name | Segment starting position | Segment ending position |
|---|---|---|
| HUMPHOSLIP_PEA_2_T6 (SEQ ID NO:51) | 1681 | 1703 |
| HUMPHOSLIP_PEA_2_T7 (SEQ ID NO:52) | 1819 | 1841 |
| HUMPHOSLIP_PEA_2_T14 (SEQ ID NO:53) | 1812 | 1834 |
| HUMPHOSLIP_PEA_2_T16 (SEQ ID NO:54) | 1720 | 1742 |
| HUMPHOSLIP_PEA_2_T17 (SEQ ID NO:55) | 1442 | 1464 |
| HUMPHOSLIP_PEA_2_T18 (SEQ ID NO:56) | 1656 | 1678 |
| HUMPHOSLIP_PEA_2_T19 (SEQ ID NO:57) | 1810 | 1832 |

Segment cluster HUMPHOSLIP_PEA_2_node_63 (SEQ ID NO:561) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 510 below describes the starting and ending position of this segment on each transcript.

TABLE 510

Segment location on transcripts

| Transcript name | Segment starting position | Segment ending position |
|---|---|---|
| HUMPHOSLIP_PEA_2_T6 (SEQ ID NO:51) | 1704 | 1727 |
| HUMPHOSLIP_PEA_2_T7 (SEQ ID NO:52) | 1842 | 1865 |
| HUMPHOSLIP_PEA_2_T14 (SEQ ID NO:53) | 1835 | 1858 |
| HUMPHOSLIP_PEA_2_T16 (SEQ ID NO:54) | 1743 | 1766 |
| HUMPHOSLIP_PEA_2_T17 (SEQ ID NO:55) | 1465 | 1488 |
| HUMPHOSLIP_PEA_2_T18 (SEQ ID NO:56) | 1679 | 1702 |
| HUMPHOSLIP_PEA_2_T19 (SEQ ID NO:57) | 1833 | 1856 |

Segment cluster HUMPHOSLIP_PEA_2_node_64 (SEQ ID NO:562) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 511 below describes the starting and ending position of this segment on each transcript.

TABLE 511

Segment location on transcripts

| Transcript name | Segment starting position | Segment ending position |
|---|---|---|
| HUMPHOSLIP_PEA_2_T6 (SEQ ID NO:51) | 1728 | 1734 |
| HUMPHOSLIP_PEA_2_T7 (SEQ ID NO:52) | 1866 | 1872 |
| HUMPHOSLIP_PEA_2_T14 (SEQ ID NO:53) | 1859 | 1865 |
| HUMPHOSLIP_PEA_2_T16 (SEQ ID NO:54) | 1767 | 1773 |
| HUMPHOSLIP_PEA_2_T17 (SEQ ID NO:55) | 1489 | 1495 |
| HUMPHOSLIP_PEA_2_T18 (SEQ ID NO:56) | 1703 | 1709 |
| HUMPHOSLIP_PEA_2_T19 (SEQ ID NO:57) | 1857 | 1863 |

Segment cluster HUMPHOSLIP_PEA_2_node_65 (SEQ ID NO:563) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 512 below describes the starting and ending position of this segment on each transcript.

TABLE 512

Segment location on transcripts

| Transcript name | Segment starting position | Segment ending position |
|---|---|---|
| HUMPHOSLIP_PEA_2_T6 (SEQ ID NO:51) | 1735 | 1754 |
| HUMPHOSLIP_PEA_2_T7 (SEQ ID NO:52) | 1873 | 1892 |
| HUMPHOSLIP_PEA_2_T14 (SEQ ID NO:53) | 1866 | 1885 |
| HUMPHOSLIP_PEA_2_T16 (SEQ ID NO:54) | 1774 | 1793 |
| HUMPHOSLIP_PEA_2_T17 (SEQ ID NO:55) | 1496 | 1515 |
| HUMPHOSLIP_PEA_2_T18 (SEQ ID NO:56) | 1710 | 1729 |
| HUMPHOSLIP_PEA_2_T19 (SEQ ID NO:57) | 1864 | 1883 |

Segment cluster HUMPHOSLIP_PEA_2_node_66 (SEQ ID NO:564) according to the present invention is supported by 180 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 513 below describes the starting and ending position of this segment on each transcript.

TABLE 513

Segment location on transcripts

| Transcript name | Segment starting position | Segment ending position |
|---|---|---|
| HUMPHOSLIP_PEA_2_T6 (SEQ ID NO:51) | 1755 | 1844 |
| HUMPHOSLIP_PEA_2_T7 (SEQ ID NO:52) | 1893 | 1982 |
| HUMPHOSLIP_PEA_2_T14 (SEQ ID NO:53) | 1886 | 1975 |
| HUMPHOSLIP_PEA_2_T16 (SEQ ID NO:54) | 1794 | 1883 |
| HUMPHOSLIP_PEA_2_T17 (SEQ ID NO:55) | 1516 | 1605 |
| HUMPHOSLIP_PEA_2_T18 (SEQ ID NO:56) | 1730 | 1819 |
| HUMPHOSLIP_PEA_2_T19 (SEQ ID NO:57) | 1884 | 1973 |

Segment cluster HUMPHOSLIP_PEA_2_node_67 (SEQ ID NO:565) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 514 below describes the starting and ending position of this segment on each transcript.

TABLE 514

Segment location on transcripts

| Transcript name | Segment starting position | Segment ending position |
|---|---|---|
| HUMPHOSLIP_PEA_2_T6 (SEQ ID NO:51) | 1845 | 1866 |
| HUMPHOSLIP_PEA_2_T7 (SEQ ID NO:52) | 1983 | 2004 |
| HUMPHOSLIP_PEA_2_T14 (SEQ ID NO:53) | 1976 | 1997 |
| HUMPHOSLIP_PEA_2_T16 (SEQ ID NO:54) | 1884 | 1905 |
| HUMPHOSLIP_PEA_2_T17 (SEQ ID NO:55) | 1606 | 1627 |
| HUMPHOSLIP_PEA_2_T18 (SEQ ID NO:56) | 1820 | 1841 |
| HUMPHOSLIP_PEA_2_T19 (SEQ ID NO:57) | 1974 | 1995 |

Segment cluster HUMPHOSLIP_PEA_2_node_69 (SEQ ID NO:566) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 515 below describes the starting and ending position of this segment on each transcript.

TABLE 515

Segment location on transcripts

| Transcript name | Segment starting position | Segment ending position |
|---|---|---|
| HUMPHOSLIP_PEA_2_T6 (SEQ ID NO:51) | 2286 | 2297 |
| HUMPHOSLIP_PEA_2_T7 (SEQ ID NO:52) | 2424 | 2435 |
| HUMPHOSLIP_PEA_2_T14 (SEQ ID NO:53) | 2417 | 2428 |
| HUMPHOSLIP_PEA_2_T16 (SEQ ID NO:54) | 2325 | 2336 |
| HUMPHOSLIP_PEA_2_T17 (SEQ ID NO:55) | 2047 | 2058 |
| HUMPHOSLIP_PEA_2_T18 (SEQ ID NO:56) | 2261 | 2272 |
| HUMPHOSLIP_PEA_2_T19 (SEQ ID NO:57) | 2415 | 2426 |

Segment cluster HUMPHOSLIP_PEA_2_node_71 (SEQ ID NO:567) according to the present invention can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 516 below describes the starting and ending position of this segment on each transcript.

TABLE 516

Segment location on transcripts

| Transcript name | Segment starting position | Segment ending position |
|---|---|---|
| HUMPHOSLIP_PEA_2_T6 (SEQ ID NO:51) | 2530 | 2542 |
| HUMPHOSLIP_PEA_2_T7 (SEQ ID NO:52) | 2668 | 2680 |
| HUMPHOSLIP_PEA_2_T14 (SEQ ID NO:53) | 2661 | 2673 |
| HUMPHOSLIP_PEA_2_T16 (SEQ ID NO:54) | 2569 | 2581 |
| HUMPHOSLIP_PEA_2_T17 (SEQ ID NO:55) | 2291 | 2303 |
| HUMPHOSLIP_PEA_2_T18 (SEQ ID NO:56) | 2505 | 2517 |
| HUMPHOSLIP_PEA_2_T19 (SEQ ID NO:57) | 2659 | 2671 |

Segment cluster HUMPHOSLIP_PEA_2_node_72 (SEQ ID NO:568) according to the present invention is supported by 7 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 517 below describes the starting and ending position of this segment on each transcript.

TABLE 517

Segment location on transcripts

| Transcript name | Segment starting position | Segment ending position |
|---|---|---|
| HUMPHOSLIP_PEA_2_T6 (SEQ ID NO:51) | 2543 | 2647 |
| HUMPHOSLIP_PEA_2_T7 (SEQ ID NO:52) | 2681 | 2785 |
| HUMPHOSLIP_PEA_2_T14 (SEQ ID NO:53) | 2674 | 2778 |
| HUMPHOSLIP_PEA_2_T16 (SEQ ID NO:54) | 2582 | 2686 |
| HUMPHOSLIP_PEA_2_T17 (SEQ ID NO:55) | 2304 | 2408 |
| HUMPHOSLIP_PEA_2_T18 (SEQ ID NO:56) | 2518 | 2622 |
| HUMPHOSLIP_PEA_2_T19 (SEQ ID NO:57) | 2672 | 2776 |

Segment cluster HUMPHOSLIP_PEA_2_node_73 (SEQ ID NO:569) according to the present invention is supported by 5 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 518 below describes the starting and ending position of this segment on each transcript.

TABLE 518

Segment location on transcripts

| Transcript name | Segment starting position | Segment ending position |
|---|---|---|
| HUMPHOSLIP_PEA_2_T6 (SEQ ID NO:51) | 2648 | 2755 |
| HUMPHOSLIP_PEA_2_T7 (SEQ ID NO:52) | 2786 | 2893 |
| HUMPHOSLIP_PEA_2_T14 (SEQ ID NO:53) | 2779 | 2886 |
| HUMPHOSLIP_PEA_2_T16 (SEQ ID NO:54) | 2687 | 2794 |
| HUMPHOSLIP_PEA_2_T17 (SEQ ID NO:55) | 2409 | 2516 |
| HUMPHOSLIP_PEA_2_T18 (SEQ ID NO:56) | 2623 | 2730 |
| HUMPHOSLIP_PEA_2_T19 (SEQ ID NO:57) | 2777 | 2884 |

Segment cluster HUMPHOSLIP_PEA_2_node_74 (SEQ ID NO:570) according to the present invention is supported by 10 libraries. The number of libraries was determined as previously described. This segment can be found in the following transcript(s): HUMPHOSLIP_PEA_2_T6 (SEQ ID NO:51), HUMPHOSLIP_PEA_2_T7 (SEQ ID NO:52), HUMPHOSLIP_PEA_2_T14 (SEQ ID NO:53), HUMPHOSLIP_PEA_2_T16 (SEQ ID NO:54), HUMPHOSLIP_PEA_2_T17 (SEQ ID NO:55), HUMPHOSLIP_PEA_2_T18 (SEQ ID NO:56) and HUMPHOSLIP_PEA_2_T19 (SEQ ID NO:57). Table 519 below describes the starting and ending position of this segment on each transcript.

TABLE 519

Segment location on transcripts

| Transcript name | Segment starting position | Segment ending position |
|---|---|---|
| HUMPHOSLIP_PEA_2_T6 (SEQ ID NO:51) | 2756 | 2845 |
| HUMPHOSLIP_PEA_2_T7 (SEQ ID NO:52) | 2894 | 2983 |
| HUMPHOSLIP_PEA_2_T14 (SEQ ID NO:53) | 2887 | 2976 |
| HUMPHOSLIP_PEA_2_T16 (SEQ ID NO:54) | 2795 | 2884 |
| HUMPHOSLIP_PEA_2_T17 (SEQ ID NO:55) | 2517 | 2606 |
| HUMPHOSLIP_PEA_2_T18 (SEQ ID NO:56) | 2731 | 2820 |
| HUMPHOSLIP_PEA_2_T19 (SEQ ID NO:57) | 2885 | 2974 |

Variant protein alignment to the previously known protein:

Sequence name: PLTP_HUMAN (SEQ ID NO:1433)

Sequence documentation:

Alignment of: HUMPHOSLIP_PEA_2_P10 (SEQ ID NO:1327) x PLTP_HUMAN (SEQ ID NO:1433) . . .

Alignment segment 1/1:

| Quality: | 3716.00 | Escore: | 0 |
|---|---|---|---|
| Matching length: | 398 | Total length: | 493 |
| Matching Percent Similarity: | 100.00 | Matching Percent Identity: | 100.00 |
| Total Percent Similarity: | 80.73 | Total Percent Identity: | 80.73 |
| Gaps: | 1 | | |

Alignment:

```
  1 MALFGALFLALLAGAHAEFPGCKIRVTSKALELVKQEGLRFLEQELETIT   50
    |||||||:|||||||||||||||||||||||||||||||||||||||||||
  1 MALFGALGLALLAGAHAEFPGCKIRVTSKALELVKQEGLRFLEQELETIT   50

51 IPDLRGKEGHFYYNISE.................................  67
    |||||||||||||||||
 51 IPDLRGKEGHFYYNISEVKVTELQLTSSELDFQPQQELMLQITNASLGLR  100

67 ..................................................  67

101 FRRQLLYWFFYDGGYINASAEGVSIRTGLELSRDPAGRMKVSNVSCQASV  150

68 ............KVYDFLSTFITSGMRFLLNQQICPVLYHAGTVLLNSLL  105
                |||||||||||||||||||||||||||||||||||||
151 SRMHAAFGGTFKKVYDFLSTFITSGMRFLLNQQICPVLYHAGTVLLNSLL  200

106 DTVPVRSSVDELVGIDYSLMKDPVASTSNLDMDFRGAFFPLTERNWSLPN  155
    |||||||||||||||||||||||||||||||||||||||||||||||||
201 DTVPVRSSVDELVGIDYSLMKDPVASTSNLDMDFRGAFFPLTERNWSLPN  250

156 RAVEPQLQEEERMVYVAFSEFFFDSAMESYFRAGALQLLLVGDKVPHDLD  205
    |||||||||||||||||||||||||||||||||||||||||||||||||
251 RAVEPQLQEEERMVYVAFSEFFFDSAMESYFRAGALQLLLVGDKVPHDLD  300

206 MLLRATYFGSIVLLSPAVIDSPLKLELRVLAPPRCTIKPSGTTISVTASV  255
    |||||||||||||||||||||||||||||||||||||||||||||||||
301 MLLRATYFGSIVLLSPAVIDSPLKLELRVLAPPRCTIKPSGTTISVTASV  350

256 TIALVPPDQPEVQLSSMTMDARLSAKMALRGKALRTQLDLRRFRIYSNHS  305
    |||||||||||||||||||||||||||||||||||||||||||||||||
351 TIALVPPDQPEVQLSSMTMDARLSAKMALRGKALRTQLDLRRFRIYSNHS  400

306 ALESLALIPLQAPLKTMLQIGVMPMLNERTWRGVQIPLPEGINFVHEVVT  355
    |||||||||||||||||||||||||||||||||||||||||||||||||
401 ALESLALIPLQAPLKTMLQIGVMPMLNERTWRGVQIPLPEGINFVHEVVT  450
```

-continued

```
356 NHAGFKTIGADLHFAKGLREVIEKNRPADVRASTAPTPSTAAV    398
    ||||||||||||||||||||||||||||||||||||||||||
451 NHAGFKTIGADLHFAKGLREVIEKNRPADVRASTAPTPSTAAV    493
```

Sequence name: PLTP_HUMAN (SEQ ID NO:1433)
Sequence documentation:
Alignment of: HUMPHOSLIP_PEA_2_P12 (SEQ ID NO:1328) x PLTP_HUMAN (SEQ ID NO:1433) . . .
Alignment segment 1/1:

| | | | |
|---|---|---|---|
| Quality: | 4101.00 | Escore: | 0 |
| Matching length: | 427 | Total length: | 427 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence name: PLTP_HUMAN (SEQ ID NO:1433)
Sequence documentation:
Alignment of: HUMPHOSLIP_PEA_2_P31 (SEQ ID NO:1330) x PLTP_HUMAN (SEQ ID NO:1433) . . .
Alignment segment 1/1:

| | | | |
|---|---|---|---|
| Quality: | 639.00 | Escore: | 0 |
| Matching length: | 67 | Total length: | 67 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MALFGALFLALLAGAHAEFPGCKIRVTSKALELVKQEGLRFLEQELETIT   50
    |||||||||||||||||||||||||||||||||||||||||||||||||
  1 MALFGALFLALLAGAHAEFPGCKIRVTSKALELVKQEGLRFLEQELETIT   50

51 IPDLRGKEGHFYYNISEVKVTELQLTSSELDFQPQQELMLQITNASLGLR  100
    |||||||||||||||||||||||||||||||||||||||||||||||||
 51 IPDLRGKEGHFYYNISEVKVTELQLTSSELDFQPQQELMLQITNASLGLR  100

101 FRRQLLYWFFYDGGYINASAEGVSIRTGLELSRDPAGRMKVSNVSCQASV  150
    |||||||||||||||||||||||||||||||||||||||||||||||||
101 FRRQLLYWFFYDGGYINASAEGVSIRTGLELSRDPAGRMKVSNVSCQASV  150

151 SRMHAAFGGTFKKVYDFLSTFITSGMRFLLNQQICPVLYHAGTVLLNSLL  200
    |||||||||||||||||||||||||||||||||||||||||||||||||
151 SRMHAAFGGTFKKVYDFLSTFITSGMRFLLNQQICPVLYHAGTVLLNSLL  200

201 DTVPVRSSVDELVGIDYSLMKDPVASTSNLDMDFRGAFFPLTERNWSLPN  250
    |||||||||||||||||||||||||||||||||||||||||||||||||
201 DTVPVRSSVDELVGIDYSLMKDPVASTSNLDMDFRGAFFPLTERNWSLPN  250

251 RAVEPQLQEEERMVYVAFSEFFFDSAMESYFRAGALQLLLVGDKVPHDLD  300
    |||||||||||||||||||||||||||||||||||||||||||||||||
251 RAVEPQLQEEERMVYVAFSEFFFDSAMESYFRAGALQLLLVGDKVPHDLD  300

301 MLLRATYFGSIVLLSPAVIDSPLKLELRVLAPPRCTIKPSGTTISVTASV  350
    |||||||||||||||||||||||||||||||||||||||||||||||||
301 MLLRATYFGSIVLLSPAVIDSPLKLELRVLAPPRCTIKPSGTTISVTASV  350

351 TIALVPPDQPEVQLSSMTMDARLSAKMALRGKALRTQLDLRRFEIYSNHS  400
    |||||||||||||||||||||||||||||||||||||||||||||||||
351 TIALVPPDQPEVQLSSMTMDARLSAKMALRGKALRTQLDLRRFEIYSNHS  400

401 ALESLALIPLQAPLKTMLQIGVMPMLN                         427
    ||||||||||||||||||||||||||
401 ALESLALIPLQAPLKTMLQIGVMPMLN                         427
```

Alignment:

```
  1 MALFGALFLALLAGAHAEFPGCKIRVTSKALELVKQEGLRFLEQELETIT   50
    |||||||||||||||||||||||||||||||||||||||||||||||||
  1 MALFGALFLALLAGAHAEFPGCKIRVTSKALELVKQEGLRFLEQELETIT   50

51 IPDLRGKEGHFYYNISE                                   67
    |||||||||||||||||
 51 IPDLRGKEGHFYYNISE                                   67
```

Sequence name: PLTP_HUMAN (SEQ ID NO:1433)

Sequence documentation:

Alignment of: HUMPHOSLIP_PEA_2_P33 (SEQ ID NO:1331) x PLTP_HUMAN (SEQ ID NO:1433) . . .

Alignment segment 1/1:

| | | | |
|---|---|---|---|
| Quality: | 1767.00 | Escore: | 0 |
| Matching length: | 184 | Total length: | 184 |
| Matching Percent Similarity: | 100.00 | Matching Percent Identity: | 99.46 |
| Total Percent Similarity: | 100.00 | Total Percent Identity: | 99.46 |
| Gaps: | 0 | | |

Alignment:

```
  1  MALFGALFLALLAGAHAEFPGCKIRVTSKALELVKQEGLRFLEQELETIT    50
     ||||||||||||||||||||||||||||||||||||||||||||||||||
  1  MALFGALFLALLAGAHAEFPGCKIRVTSKALELVKQEGLRFLEQELETIT    50

51  IPDLRGKEGHFYYNISEVKVTELQLTSSELDFQPQQELMLQITNASLGLR   100
     ||||||||||||||||||||||||||||||||||||||||||||||||||
 51  IPDLRGKEGHFYYNISEVKVTELQLTSSELDFQPQQELMLQITNASLGLR   100

101  FRRQLLYWFFYDGGYINASAEGVSIRTGLELSRDPAGRMKVSNVSCQASV   150
     ||||||||||||||||||||||||||||||||||||||||||||||||||
101  FRRQLLYWFFYDGGYINASAEGVSIRTGLELSRDPAGRMKVSNVSCQASV   150

151  SRMHAAFGGTFKKVYDFLSTFITSGMRFLLNQQV                  184
     |||||||||||||||||||||||||||||||||:
151  SRMHAAFGGTFKKVYDFLSTFITSGMRFLLNQQI                  184
```

Sequence name: PLTP_HUMAN (SEQ ID NO:1433)

Sequence documentation:

Alignment of: HUMPHOSLIP_PEA_2_P34 (SEQ ID NO:1332) x PLTP_HUMAN (SEQ ID NO:1433) . . .

Alignment segment 1/1:

| | | | |
|---|---|---|---|
| Quality: | 1971.00 | Escore: | 0 |
| Matching length: | 205 | Total length: | 205 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MALFGALFLALLAGAHAEFPGCKIRVTSKALELVKQEGLRFLEQELETIT    50
     ||||||||||||||||||||||||||||||||||||||||||||||||||
  1  MALFGALFLALLAGAHAEFPGCKIRVTSKALELVKQEGLRFLEQELETIT    50

51  IPDLRGKEGHFYYNISEVKVTELQLTSSELDFQPQQELMLQITNASLGLR   100
     ||||||||||||||||||||||||||||||||||||||||||||||||||
 51  IPDLRGKEGHFYYNISEVKVTELQLTSSELDFQPQQELMLQITNASLGLR   100

101  FRRQLLYWFFYDGGYINASAEGVSIRTGLELSRDPAGRMKVSNVSCQASV   150
     ||||||||||||||||||||||||||||||||||||||||||||||||||
101  FRRQLLYWFFYDGGYINASAEGVSIRTGLELSRDPAGRMKVSNVSCQASV   150

151  SRMHAAFGGTFKKVYDFLSTFITSGMRFLLNQQICPVLYHAGTVLLNSLL   200
     ||||||||||||||||||||||||||||||||||||||||||||||||||
151  SRMHAAFGGTFKKVYDFLSTFITSGMRFLLNQQICPVLYHAGTVLLNSLL   200

201  DTVPV                                               205
     |||||
201  DTVPV                                               205
```

Sequence name: PLTP_HUMAN (SEQ ID NO:1433)

Sequence documentation:

Alignment of: HUMPHOSLIP_PEA_2_P35 (SEQ ID NO:1333) x PLTP_HUMAN (SEQ ID NO:1433) . . .

Alignment segment 1/1:

| Quality: | 1158.00 | Escore: | 0 |
|---|---|---|---|
| Matching length: | 132 | Total length: | 184 |
| Matching Percent Similarity: | 100.00 | Matching Percent Identity: | 98.48 |
| Total Percent Similarity: | 71.74 | Total Percent Identity: | 70.65 |
| Gaps: | 1 | | |

Alignment:

```
  1 MALFGALFLALLAGAHAEFPGCKIRVTSKALELVKQEGLRFLEQELETIT   50
    |||||||||||||||||||||||||||||||||||||||||||||||||
  1 MALFGALFLALLAGAHAEFPGCKIRVTSKALELVKQEGLRFLEQELETIT   50

51 IPDLRGKEGHFYYNISEVKVTELQLTSSELDFQPQQELMLQITNASLGLR  100
    |||||||||||||||||||||||||||||||||||||||||||||||||
 51 IPDLRGKEGHFYYNISEVKVTELQLTSSELDFQPQQELMLQITNASLGLR  100

101 FRRQLLYWFL........................................  110
    ||||||||||:
101 FRRQLLYWFFYDGGYINASAEGVSIRTGLELSRDPAGRMKVSNVSCQASV  150

111 ............KVYDFLSTFITSGMRFLLNQQV                 132
                ||||||||||||||||||||||:
151 SRMHAAFGGTFKKVYDFLSTFITSGMRFLLNQQI                 184
```

Description for Cluster AI076020

Cluster AI076020 features 1 transcript(s) and 8 segment(s) of interest, the names for which are given in Tables 520 and 521, respectively, the sequences themselves are given at the end of the application. The selected protein variants are given in table 522.

TABLE 520

Transcripts of interest

| Transcript Name | Sequence ID No. |
|---|---|
| AI076020_T0 | 58 |

TABLE 521

Segments of interest

| Segment Name | Sequence ID No. |
|---|---|
| AI076020_node_0 | 571 |
| AI076020_node_3 | 572 |
| AI076020_node_8 | 573 |
| AI076020_node_1 | 574 |
| AI076020_node_4 | 575 |
| AI076020_node_5 | 576 |
| AI076020_node_6 | 577 |
| AI076020_node_7 | 578 |

TABLE 522

Proteins of interest

| Protein Name | Sequence ID No. | Corresponding Transcript(s) |
|---|---|---|
| AI076020_P1 | 1334 | AI076020_T0 (SEQ ID NO:58) |

These sequences are variants of the known protein C1q-related factor precursor (SwissProt accession identifier C1RF_HUMAN), SEQ ID NO:1434, referred to herein as the previously known protein.

The sequence for protein C1q-related factor precursor (SEQ ID NO:1434) is given at the end of the application, as "C1q-related factor precursor amino acid sequence".

The following GO Annotation(s) apply to the previously known protein. The following annotation(s) were found: locomotory behavior, which are annotation(s) related to Biological Process.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster AI076020 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 31 refer to weighted expression of ESTs in each category, as "parts per million" (ratio of the expression of ESTs for a particular cluster to the expression of all ESTs in that category, according to parts per million).

Figure 31:
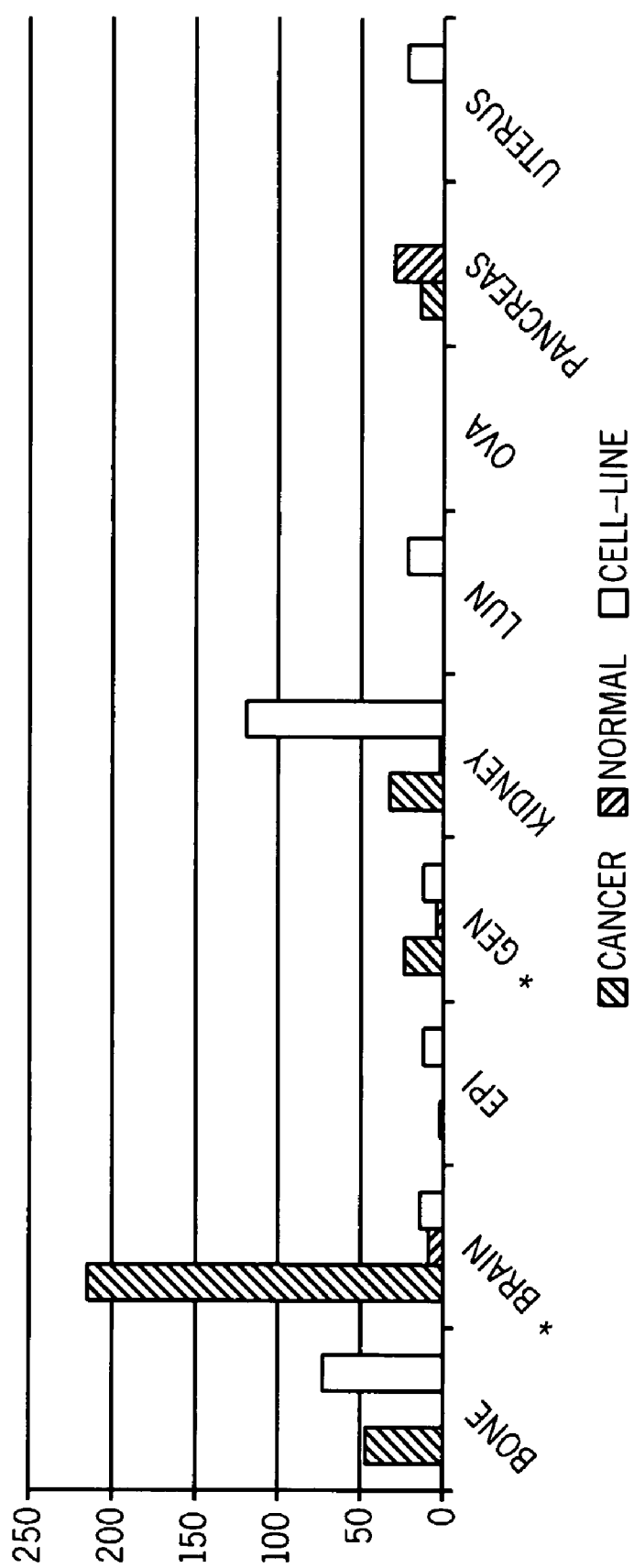
FIG. 31 is a histogram showing Cancer and cell-line vs. normal tissue expression for Cluster AA161187, demonstrating overexpression in brain malignant tumors and a mixture of malignant tumors from different tissues.

Overall, the following results were obtained as shown with regard to the histograms in FIG. 31 and Table 523. This cluster is overexpressed (at least at a minimum level) in the following pathological conditions: brain malignant tumors and a mixture of malignant tumors from different tissues.

TABLE 523

Normal tissue distribution

| Name of Tissue | Number |
|---|---|
| bone | 0 |
| brain | 9 |
| epithelial | 0 |

TABLE 523-continued

Normal tissue distribution

| Name of Tissue | Number |
|---|---|
| general | 4 |
| kidney | 2 |
| lung | 0 |
| ovary | 0 |
| pancreas | 30 |
| uterus | 0 |

TABLE 524

P values and ratios for expression in cancerous tissue

| Name of Tissue | P1 | P2 | SP1 | R3 | SP2 | R4 |
|---|---|---|---|---|---|---|
| bone | 3.3e−01 | 5.9e−02 | 4.0e−01 | 2.5 | 2.4e−01 | 3.0 |
| brain | 8.8e−04 | 2.2e−03 | 5.5e−11 | 14.2 | 4.6e−08 | 8.7 |
| epithelial | 2.6e−01 | 8.6e−02 | 2.8e−01 | 2.4 | 1.8e−02 | 4.5 |
| general | 2.1e−03 | 3.0e−04 | 2.0e−06 | 4.3 | 8.4e−06 | 3.5 |
| kidney | 5.5e−01 | 3.3e−01 | 3.4e−01 | 2.3 | 8.2e−02 | 3.3 |
| lung | 1 | 6.3e−01 | 1 | 1.0 | 3.8e−01 | 2.2 |
| ovary | 4.2e−01 | 4.5e−01 | 0.0e+00 | 0.0 | 0.0e+00 | 0.0 |
| pancreas | 6.0e−01 | 7.1e−01 | 8.9e−01 | 0.6 | 9.5e−01 | 0.5 |
| uterus | 1 | 4.0e−01 | 1 | 1.0 | 6.4e−01 | 1.5 |

As noted above, cluster AI076020 features 1 transcript(s), which were listed in Table 520 above. These transcript(s) encode for protein(s) which are variant(s) of protein C1q-related factor precursor (SEQ ID NO:1434). A description of each variant protein according to the present invention is now provided.

Variant protein AI076020_P1 (SEQ ID NO:1334) according to the present invention has an amino acid sequence as given at the end of the application; it is encoded by transcript(s) AI076020_T0 (SEQ ID NO:58). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein AI076020_P1 (SEQ ID NO:1334) also has the following non-silent SNPs (Single Nucleotide Polymorphisms) as listed in Table 525, (given according to their position(s) on the amino acid sequence, with the alternative amino acid(s) listed; the last column indicates whether the SNP is known or not; the presence of known SNPs in variant protein AI076020_P1 (SEQ ID NO:1334) sequence provides support for the deduced sequence of this variant protein according to the present invention).

TABLE 525

Amino acid mutations

| SNP position(s) on amino acid sequence | Alternative amino acid(s) | Previously known SNP? |
|---|---|---|
| 36 | P -> R | Yes |
| 66 | Q -> R | Yes |
| 165 | K -> R | Yes |

Variant protein AI076020_P1 (SEQ ID NO:1334) is encoded by the following transcript(s): AI076020_T0 (SEQ ID NO:58), for which the sequence(s) is/are given at the end of the application. The coding portion of transcript AI076020_T0 (SEQ ID NO:58) is shown in bold; this coding portion starts at position 261 and ends at position 1034. The transcript also has the following SNPs as listed in Table 526 (given according to their position on the nucleotide sequence, with the alternative nucleic acid listed; the last column indicates whether the SNP is known or not; the presence of known SNPs in variant protein AI076020_P1 (SEQ ID NO:1334) sequence provides support for the deduced sequence of this variant protein according to the present invention).

TABLE 526

Nucleic acid SNPs

| SNP position on nucleotide sequence | Alternative nucleic acid | Previously known SNP? |
|---|---|---|
| 367 | C -> G | Yes |
| 457 | A -> G | Yes |
| 464 | C -> A | Yes |
| 754 | A -> G | Yes |
| 1265 | C -> T | Yes |
| 1384 | C -> T | Yes |
| 1402 | G -> C | Yes |
| 1452 | T -> G | Yes |

As noted above, cluster AI076020 features 8 segment(s), which were listed in Table 521 above and for which the sequence(s) are given at the end of the application. These segment(s) are portions of nucleic acid sequence(s) which are described herein separately because they are of particular interest. A description of each segment according to the present invention is now provided.

Segment cluster AI076020_node_0 (SEQ ID NO:571) according to the present invention is supported by 28 libraries. The number of libraries was determined as previously described. This segment can be found in the following transcript(s): AI076020_T0 (SEQ ID NO:58). Table 527 below describes the starting and ending position of this segment on each transcript.

TABLE 527

Segment location on transcripts

| Transcript name | Segment starting position | Segment ending position |
|---|---|---|
| AI076020_T0 (SEQ ID NO:58) | 1 | 774 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 528.

TABLE 528

Oligonucleotides related to this segment

| Oligonucleotide name | Overexpressed in cancers | Chip reference |
|---|---|---|
| AI076020_0_3_0 (SEQ ID NO:226) | lung malignant tumors | LUN |

Segment cluster AI076020_node_3 (SEQ ID NO:572) according to the present invention is supported by 30 libraries. The number of libraries was determined as previously described. This segment can be found in the following transcript(s): AI076020_T0 (SEQ ID NO:58). Table 529 below describes the starting and ending position of this segment on each transcript.

TABLE 529

Segment location on transcripts

| Transcript name | Segment starting position | Segment ending position |
|---|---|---|
| AI076020_T0 (SEQ ID NO:58) | 858 | 1027 |

Segment cluster AI076020_node_8 (SEQ ID NO:573) according to the present invention is supported by 35 libraries. The number of libraries was determined as previously described. This segment can be found in the following transcript(s): AI076020_T0 (SEQ ID NO:58). Table 530 below describes the starting and ending position of this segment on each transcript.

TABLE 530

Segment location on transcripts

| Transcript name | Segment starting position | Segment ending position |
|---|---|---|
| AI076020_T0 (SEQ ID NO:58) | 1359 | 1533 |

According to an optional embodiment of the present invention, short segments related to the above cluster are also provided. These segments are up to about 120 bp in length, and so are included in a separate description.

Segment cluster AI076020_node_1 (SEQ ID NO:574) according to the present invention is supported by 19 libraries. The number of libraries was determined as previously described. This segment can be found in the following transcript(s): AI076020_T0 (SEQ ID NO:58). Table 531 below describes the starting and ending position of this segment on each transcript.

TABLE 531

Segment location on transcripts

| Transcript name | Segment starting position | Segment ending position |
|---|---|---|
| AI076020_T0 (SEQ ID NO:58) | 775 | 857 |

Segment cluster AI076020_node_4 (SEQ ID NO:575) according to the present invention is supported by 28 libraries. The number of libraries was determined as previously described. This segment can be found in the following transcript(s): AI076020_T0 (SEQ ID NO:58). Table 532 below describes the starting and ending position of this segment on each transcript.

TABLE 532

Segment location on transcripts

| Transcript name | Segment starting position | Segment ending position |
|---|---|---|
| AI076020_T0 (SEQ ID NO:58) | 1028 | 1129 |

Segment cluster AI076020_node_5 (SEQ ID NO:576) according to the present invention is supported by 31 libraries. The number of libraries was determined as previously described. This segment can be found in the following transcript(s): AI076020_T0 (SEQ ID NO:58). Table 533 below describes the starting and ending position of this segment on each transcript.

TABLE 533

Segment location on transcripts

| Transcript name | Segment starting position | Segment ending position |
|---|---|---|
| AI076020_T0 (SEQ ID NO:58) | 1130 | 1244 |

Segment cluster AI076020_node_6 (SEQ ID NO:577) according to the present invention is supported by 32 libraries. The number of libraries was determined as previously described. This segment can be found in the following transcript(s): AI076020_T0 (SEQ ID NO:58). Table 534 below describes the starting and ending position of this segment on each transcript.

TABLE 534

Segment location on transcripts

| Transcript name | Segment starting position | Segment ending position |
|---|---|---|
| AI076020_T0 (SEQ ID NO:58) | 1245 | 1320 |

Segment cluster AI076020_node_7 (SEQ ID NO:578) according to the present invention is supported by 33 libraries. The number of libraries was determined as previously described. This segment can be found in the following transcript(s): AI076020_T0 (SEQ ID NO:58). Table 535 below describes the starting and ending position of this segment on each transcript.

TABLE 535

Segment location on transcripts

| Transcript name | Segment starting position | Segment ending position |
|---|---|---|
| AI076020_T0 (SEQ ID NO:58) | 1321 | 1358 |

Description for Cluster T23580

Cluster T23580 features 1 transcript(s) and 5 segment(s) of interest, the names for which are given in Tables 536 and 537, respectively, the sequences themselves are given at the end of the application. The selected protein variants are given in table 538.

TABLE 536

Transcripts of interest

| Transcript Name | Sequence ID No. |
|---|---|
| T23580_T10 | 1626 |

TABLE 537

Segments of interest

| Segment Name | Sequence ID No. |
|---|---|
| T23580_node_17 | 579 |
| T23580_node_18 | 580 |
| T23580_node_21 | 581 |
| T23580_node_19 | 582 |
| T23580_node_20 | 583 |

TABLE 538

Proteins of interest

| Protein Name | Sequence ID No. | Corresponding Transcript(s) |
|---|---|---|
| T23580_P5 | 1335 | T23580_T10 (SEQ ID NO:1626) |

These sequences are variants of the known protein Neuronal protein NP25 (SwissProt accession identifier TAG3_HUMAN; known also according to the synonyms Neuronal protein 22; NP22; Transgelin-3), SEQ ID NO: 1435, referred to herein as the previously known protein and also as NP25_HUMAN, which is the former SwissProt accession identifier.

The sequence for protein Neuronal protein NP25 (SEQ ID NO:1435) is given at the end of the application, as "Neuronal protein NP25 amino acid sequence".

The following GO Annotation(s) apply to the previously known protein. The following annotation(s) were found: central nervous system development, which are annotation(s) related to Biological Process.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below, shown in Table 539, with regard to lung cancer.

TABLE 539

Oligonucleotides related to this cluster

| Oligonucleotide name | Overexpressed in cancers | Chip reference |
|---|---|---|
| T23580_0_0_902 (SEQ ID NO: 227) | lung malignant tumors | LUN |

As noted above, cluster T23580 features 1 transcript(s), which were listed in Table 536 above. These transcript(s) encode for protein(s) which are variant(s) of protein Neuronal protein NP25 (SEQ ID NO:1435). A description of each variant protein according to the present invention is now provided.

Variant protein T23580_P5 (SEQ ID NO:1335) according to the present invention has an amino acid sequence as given at the end of the application; it is encoded by transcript(s) T23580_T10 (SEQ ID NO:1626). The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein T23580_P5 (SEQ ID NO:1335) also has the following non-silent SNPs (Single Nucleotide Polymorphisms) as listed in Table 540, (given according to their position(s) on the amino acid sequence, with the alternative amino acid(s) listed; the last column indicates whether the SNP is known or not; the presence of known SNPs in variant protein T23580_P5 (SEQ ID NO:1335) sequence provides support for the deduced sequence of this variant protein according to the present invention).

TABLE 540

Amino acid mutations

| SNP position(s) on amino acid sequence | Alternative amino acid(s) | Previously known SNP? |
|---|---|---|
| 129 | V -> I | Yes |

Variant protein T23580_P5 (SEQ ID NO:1335) is encoded by the following transcript(s): T23580_T10 (SEQ ID NO:1626), for which the sequence(s) is/are given at the end of the application. The coding portion of transcript T23580_T10 (SEQ ID NO:1626) is shown in bold; this coding portion starts at position 1066 and ends at position 1485. The transcript also has the following SNPs as listed in Table 541 (given according to their position on the nucleotide sequence, with the alternative nucleic acid listed; the last column indicates whether the SNP is known or not; the presence of known SNPs in variant protein T23580_P5 (SEQ ID NO:1335) sequence provides support for the deduced sequence of this variant protein according to the present invention).

TABLE 541

Nucleic acid SNPs

| SNP position on nucleotide sequence | Alternative nucleic acid | Previously known SNP? |
|---|---|---|
| 37 | A -> C | Yes |
| 320 | G -> A | Yes |
| 371 | G -> T | Yes |
| 372 | G -> A | Yes |
| 441 | A -> G | Yes |
| 699 | G -> C | Yes |
| 744 | C -> G | Yes |
| 862 | G -> T | Yes |
| 1450 | G -> A | Yes |

As noted above, cluster T23580 features 5 segment(s), which were listed in Table 537 above and for which the sequence(s) are given at the end of the application. These segment(s) are portions of nucleic acid sequence(s) which are described herein separately because they are of particular interest. A description of each segment according to the present invention is now provided.

Segment cluster T23580_node_17 (SEQ ID NO:579) according to the present invention is supported by 10 libraries. The number of libraries was determined as previously described. This segment can be found in the following transcript(s): T23580_T10 (SEQ ID NO:1626). Table 542 below describes the starting and ending position of this segment on each transcript.

TABLE 542

Segment location on transcripts

| Transcript name | Segment starting position | Segment ending position |
|---|---|---|
| T23580_T10 (SEQ ID NO:1626) | 1 | 1098 |

Segment cluster T23580_node_18 (SEQ ID NO:580) according to the present invention is supported by 102 libraries. The number of libraries was determined as previously described. This segment can be found in the following transcript(s): T23580_T10 (SEQ ID NO:1626). Table 543 below describes the starting and ending position of this segment on each transcript.

TABLE 543

Segment location on transcripts

| Transcript name | Segment starting position | Segment ending position |
|---|---|---|
| T23580_T10 (SEQ ID NO:1626) | 1099 | 1357 |

Segment cluster T23580_node_21 (SEQ ID NO:581) according to the present invention is supported by 79 libraries. The number of libraries was determined as previously described. This segment can be found in the following transcript(s): T23580_T10 (SEQ ID NO:1626). Table 544 below describes the starting and ending position of this segment on each transcript.

TABLE 544

Segment location on transcripts

| Transcript name | Segment starting position | Segment ending position |
|---|---|---|
| T23580_T10 (SEQ ID NO:1626) | 1382 | 1582 |

According to an optional embodiment of the present invention, short segments related to the above cluster are also provided. These segments are up to about 120 bp in length, and so are included in a separate description.

Segment cluster T23580_node_19 (SEQ ID NO:582) according to the present invention can be found in the following transcript(s): T23580_T10 (SEQ ID NO:1626). Table 545 below describes the starting and ending position of this segment on each transcript.

TABLE 545

Segment location on transcripts

| Transcript name | Segment starting position | Segment ending position |
|---|---|---|
| T23580_T10 (SEQ ID NO:1626) | 1358 | 1370 |

Segment cluster T23580_node_20 (SEQ ID NO:583) according to the present invention can be found in the following transcript(s): T23580_T10 (SEQ ID NO:1626). Table 546 below describes the starting and ending position of this segment on each transcript.

TABLE 546

Segment location on transcripts

| Transcript name | Segment starting position | Segment ending position |
|---|---|---|
| T23580_T10 (SEQ ID NO:1626) | 1371 | 1381 |

Description for Cluster M79217

Cluster M79217 features 6 transcript(s) and 32 segment(s) of interest, the names for which are given in Tables 547 and 548, respectively, the sequences themselves are given at the end of the application. The selected protein variants are given in table 549.

TABLE 547

Transcripts of interest

| Transcript Name | Sequence ID No. |
|---|---|
| M79217_PEA_1_T1 | 59 |
| M79217_PEA_1_T3 | 60 |
| M79217_PEA_1_T8 | 61 |
| M79217_PEA_1_T10 | 62 |
| M79217_PEA_1_T15 | 63 |
| M79217_PEA_1_T18 | 64 |

TABLE 548

Segments of interest

| Segment Name | Sequence ID No. |
|---|---|
| M79217_PEA_1_node_2 | 584 |
| M79217_PEA_1_node_4 | 585 |
| M79217_PEA_1_node_9 | 586 |
| M79217_PEA_1_node_10 | 587 |
| M79217_PEA_1_node_11 | 588 |
| M79217_PEA_1_node_13 | 589 |
| M79217_PEA_1_node_14 | 590 |
| M79217_PEA_1_node_16 | 591 |
| M79217_PEA_1_node_23 | 592 |
| M79217_PEA_1_node_24 | 593 |
| M79217_PEA_1_node_31 | 594 |
| M79217_PEA_1_node_33 | 595 |
| M79217_PEA_1_node_34 | 596 |
| M79217_PEA_1_node_35 | 597 |
| M79217_PEA_1_node_37 | 598 |
| M79217_PEA_1_node_38 | 599 |
| M79217_PEA_1_node_41 | 600 |
| M79217_PEA_1_node_44 | 601 |
| M79217_PEA_1_node_0 | 602 |

TABLE 548-continued

Segments of interest

| Segment Name | Sequence ID No. |
| --- | --- |
| M79217_PEA_1_node_7 | 603 |
| M79217_PEA_1_node_12 | 604 |
| M79217_PEA_1_node_19 | 605 |
| M79217_PEA_1_node_21 | 606 |
| M79217_PEA_1_node_26 | 607 |
| M79217_PEA_1_node_27 | 608 |
| M79217_PEA_1_node_30 | 609 |
| M79217_PEA_1_node_32 | 610 |
| M79217_PEA_1_node_36 | 611 |
| M79217_PEA_1_node_39 | 612 |
| M79217_PEA_1_node_40 | 613 |
| M79217_PEA_1_node_42 | 614 |
| M79217_PEA_1_node_43 | 615 |

TABLE 549

Proteins of interest

| Protein Name | Sequence ID No. | Corresponding Transcript(s) |
| --- | --- | --- |
| M79217_PEA_1_P1 | 1336 | M79217_PEA_1_T1 (SEQ ID NO:59); M79217_PEA_1_T3 (SEQ ID NO:60) |
| M79217_PEA_1_P2 | 1337 | M79217_PEA_1_T8 (SEQ ID NO:61) |
| M79217_PEA_1_P4 | 1338 | M79217_PEA_1_T10 (SEQ ID NO:62) |
| M79217_PEA_1_P8 | 1339 | M79217_PEA_1_T15 (SEQ ID NO:63) |
| M79217_PEA_1_P11 | 1340 | M79217_PEA_1_T18 (SEQ ID NO:64) |

These sequences are variants of the known protein Exostosin-like 3 (SwissProt accession identifier EXL3_HUMAN; known also according to the synonyms EC 2.4.1.223; Glucuronyl-galactosyl-proteoglycan 4-alpha-N-acetylglucosaminyltransferase; Putative tumor suppressor protein EXTL3; Multiple exostosis-like protein 3; Hereditary multiple exostoses gene isolog; EXT-related protein 1), SEQ ID NO:1436, referred to herein as the previously known protein.

Protein Exostosin-like 3 (SEQ ID NO:1436) is known or believed to have the following function(s): Probable glycosyltransferase (By similarity). The sequence for protein Exostosin-like 3 is given at the end of the application, as "Exostosin-like 3 amino acid sequence". Protein Exostosin-like 3 localization is believed to be Type II membrane protein. Endoplasmic reticulum.

The following GO Annotation(s) apply to the previously known protein. The following annotation(s) were found: cell growth and/or maintenance, which are annotation(s) related to Biological Process; transferase, transferring glycosyl groups, which are annotation(s) related to Molecular Function; and endoplasmic reticulum; integral membrane protein, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster M79217 features 6 transcript(s), which were listed in Table 547 above. These transcript(s) encode for protein(s) which are variant(s) of protein Exostosin-like 3 (SEQ ID NO:1436). A description of each variant protein according to the present invention is now provided.

Variant protein M79217_PEA_1_P1 (SEQ ID NO:1336) according to the present invention has an amino acid sequence as given at the end of the application; it is encoded by transcript(s) M79217_PEA_1_T1 (SEQ ID NO:59). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison report between M79217_PEA_1_P1 (SEQ ID NO:1336) and BAA25445 (SEQ ID NO:1437):

1. An isolated chimeric polypeptide encoding for M79217_PEA_1_P1 (SEQ ID NO:1336), comprising a first amino acid sequence being at least 90% homologous to MTGYTMLRNGGAGNGGQTCMLRWSNRIRLTWLSF-TLFVILVFFPLIAHYYLTTLDEADEAGKRIFGPRVG NELCEVKHVLDLCRIRESVSEELLQLEAKRQELN-SEIAKLNLKIEACKKSIENAKQDLLQLKNVISQTEHSY KELMAQNQPKLSLPIRLLPEKDDAGLPPPKATRG-CRLHNCFDYSRCPLTSGFPVYVYDSDQFVFGSYLDPL VKQAFQATARANVYVTENADIACLYVILVGEMQEP-VVLRPAELEKQLYSLPHWRTDGHNHVIINLSRKSD TQNLLYNVSTGRAMVAQSTFYTVQYRPGFDLVVS-PLVHAMSEPNFMEIPPQVPVKRKYLFTFQGEKIESLR SSLQEARSFEEEMEGDPPADYDDRIIATLKAVQDS-KLDQVLVEFTCKNQPKPSLPTEWALCGEREDRLELL KLSTFALIITPGDPRLVISSGCATRLFEALEVGAVPV-VLGEQVQLPYQDMLQWNEAALVVPKPRVTEVHFL LRSLSDSDLLAMRRQGRFLWETYFSTADSIFNTVL-AMIRTRIQIPAAPIREEAAAEIPHRSGKAAGTDPNMA DNGDLDLGPVETEPPYASPRYLRNFTLTVTDFYRSW-NCAPGPFHLFPHTPFDPVLPSEAKFLGSGTGFRPIG GGAGGSGKEFQAALGGNVPREQFTVVMLTYEREE-VLMNSLERLNGLPYLNKVVVVWNSPKLPSEDLLW PDIGVPIMVVRTEKNSLNNRFLPWNEIETEAILSID-DDAHLRHDEIMFGFRVWREARDRIVGFPGRYHAWDI PHQSWLYNSNYSCELSMVLTGAAFFHKYYAYLYSY-VMPQAIRDMVDEYINCEDIAMNFLVSHITRKPPIK VTSRWTFRCPGCPQALSHDDSHFHERHKCINFFVKV-YGYMPLLYTQFRVDSVLFKTRLPHDKTKCFKFI corresponding to amino acids 13-931 of BAA25445 (SEQ ID NO:1437), which also corresponds to amino acids 1-919 of M79217 PEA_1_P1 (SEQ ID NO:1336).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA_1_P1 (SEQ ID NO:1336) is encoded by the following transcript(s): M79217_PEA_1_T1 (SEQ ID NO:59), for which the sequence(s) is/are given at the end of the application. The coding portion of transcript M79217_PEA_1_T1 (SEQ ID NO:59) is shown in bold; this coding portion starts at position 1074 and ends at position 3830. The transcript also has the following SNPs as listed in Table 550 (given according to their position on the nucleotide sequence, with the alternative nucleic acid listed; the last column indicates whether the SNP is known or not; the presence of known SNPs in variant protein M79217_PEA_1_P1 (SEQ ID NO:1336) sequence provides support for the deduced sequence of this variant protein according to the present invention).

TABLE 550

Nucleic acid SNPs

| SNP position on nucleotide sequence | Alternative nucleic acid | Previously known SNP? |
|---|---|---|
| 1014 | C -> T | No |
| 1015 | T -> | No |
| 1072 | T -> C | No |
| 1232 | T -> A | No |
| 1383 | A -> G | No |
| 1440 | A -> G | No |
| 1544 | C -> | No |
| 1546 | G -> A | No |
| 1685 | T -> G | No |
| 2215 | C -> | No |
| 2300 | A -> G | Yes |
| 2483 | T -> C | No |
| 2518 | C -> | No |
| 2632 | T -> G | No |
| 3190 | T -> C | Yes |
| 3352 | T -> C | No |
| 3373 | G -> T | No |
| 3386 | C -> | No |
| 3449 | C -> T | Yes |
| 3618 | A -> G | No |
| 3733 | A -> G | No |
| 4021 | C -> | No |
| 4021 | C -> T | No |
| 4086 | G -> A | No |
| 4087 | G -> A | No |
| 4416 | T -> A | No |
| 4586 | G -> A | Yes |
| 4772 | C -> T | No |
| 5110 | C -> T | Yes |
| 5219 | C -> T | Yes |
| 5437 | G -> A | No |
| 5645 | G -> A | No |
| 5743 | G -> A | Yes |
| 5887 | G -> T | Yes |
| 6143 | A -> C | No |
| 6277 | G -> | No |
| 6277 | G -> C | No |
| 6295 | C -> G | Yes |
| 6308 | T -> A | No |
| 6403 | G -> A | Yes |
| 6442 | G -> | No |
| 6495 | C -> T | No |

Variant protein M79217_PEA_1_P2 (SEQ ID NO:1337) according to the present invention has an amino acid sequence as given at the end of the application; it is encoded by transcript(s) M79217_PEA_1_T8 (SEQ ID NO:61). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison report between M79217_PEA_1_P2 (SEQ ID NO:1337) and EXL3_HUMAN (SEQ ID NO:1436):

1. An isolated chimeric polypeptide encoding for M79217_PEA_1_P2 (SEQ ID NO:1337), comprising a first amino acid sequence being at least 90% homologous to MTGYTMLRNGGAGNGGQTCMLRWSNRIRLTWLS-FTLFVILVFFPLIAHYYLTTLDEADEAGKRIFGPRVG NELCEVKHVLDLCRIRESVSEELLQLEAKRQELNSE-IAKLNLKIEACKKSIENAKQDLLQLKNVISQTEHSY KELMAQNQPKLSLPIRLLPEKDDAGLPPPKATRGC-RLHNCFDYSRCPLTSGFPVYVYDSDQFVFGSYLDPL VKQAFQATARANVYVTENADIACLYVILVGEMQEP-VVLRPAELEKQLYSLPHWRTDGHNHVIINLSRKSD TQNLLYNVSTGRAMVAQSTFYTVQYRPGFDLVVSPL-VHAMSEPNFMEIPPQVPVKRKYLFTFQGEKIESLR SSLQEARSFEEEMEGDPPADYDDRIIATLKAVQDSKL-DQVLVEFTCKNQPKPSLPTEWALCGEREDRLELL KLSTFALIITPGDPRLVISSGCATRLFEALEVGAVPV-VLGEQVQLPYQDMLQWNEAALVVPKPRVTEVHFL LRSLSDSDLLAMRRQGRFLWETYFSTADSIFNTVL-AMIRTRIQIPAAPIREEAAAEIPHRSGKAAGTDPNMA DNGDLDLGPVETEPPYASPRYLRNFTLTVTDFYRS-WNCAPGPFHLFPHTPFDPVLPSEAKFLGSGTGFRPIG GGAGGSGKEFQAALGGNVPREQFTVVMLTYEREE-VLMNSLERLNGLPYLNKVVVVWNSPKLPSEDLLW PDIGVPIMVVRTEKNSLNNRFLPWNEIETEAILSID-DDAHLRHDEIMFGFRVWREARDRIVGFPGRYHAWDI PHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P2 (SEQ ID NO:1337), and a second amino acid sequence being at least 90% homologous to AIRDMVDEYINCEDIAMNFLVSHITRKP-PIKVTSRWTFRCPGCPQALSHDDSHF-HERHKCINFFVKVYGYM PLLYTQFRVDSVLFKTRL-PHDKTKCFKFI corresponding to amino acids 820-919 of EXL3_HUMAN (SEQ ID NO:1436), which also corresponds to amino acids 808-907 of M79217_PEA_1_P2 (SEQ ID NO:1337), wherein said first amino acid sequence and second amino acid sequence are contiguous and in a sequential order.

2. An isolated chimeric polypeptide encoding for an edge portion of M79217_PEA_1_P2 (SEQ ID NO:1337), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KA, having a structure as follows: a sequence starting from any of amino acid numbers 807-x to 807; and ending at any of amino acid numbers 808+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA_1_P2 (SEQ ID NO:1337) also has the following non-silent SNPs (Single Nucleotide Polymorphisms) as listed in Table 551, (given according to their position(s) on the amino acid sequence, with the alternative amino acid(s) listed; the last column indicates whether the SNP is known or not; the presence of known SNPs in variant protein M79217_PEA_1_P2 (SEQ ID NO:1337) sequence provides support for the deduced sequence of this variant protein according to the present invention).

TABLE 551

Amino acid mutations

| SNP position(s) on amino acid sequence | Alternative amino acid(s) | Previously known SNP? |
|---|---|---|
| 104 | N -> D | No |
| 123 | N -> D | No |
| 157 | I -> | No |
| 158 | R -> Q | No |
| 204 | F -> L | No |

TABLE 551-continued

Amino acid mutations

| SNP position(s) on amino acid sequence | Alternative amino acid(s) | Previously known SNP? |
|---|---|---|
| 381 | A -> | No |
| 482 | A -> | No |
| 520 | F -> C | No |
| 706 | L -> P | Yes |
| 760 | V -> A | No |
| 767 | R -> L | No |
| 771 | F -> | No |
| 837 | I -> V | No |
| 875 | Y -> C | No |

The glycosylation sites of variant protein M79217_PEA_1_P2 (SEQ ID NO:1337), as compared to the known protein Exostosin-like 3 (SEQ ID NO:1436), are described in Table 552 (given according to their position(s) on the amino acid sequence in the first column; the second column indicates whether the glycosylation site is present in the variant protein; and the last column indicates whether the position is different on the variant protein).

TABLE 552

Glycosylation site(s)

| Position(s) on known amino acid sequence | Present in variant protein? | Position in variant protein? |
|---|---|---|
| 290 | yes | 290 |
| 592 | yes | 592 |
| 790 | yes | 790 |
| 277 | yes | 277 |

Variant protein M79217_PEA_1_P2 (SEQ ID NO:1337) is encoded by the following transcript(s): M79217_PEA_1_T8 (SEQ ID NO:61), for which the sequence(s) is/are given at the end of the application. The coding portion of transcript M79217_PEA_1_T8 (SEQ ID NO:61) is shown in bold; this coding portion starts at position 748 and ends at position 3468. The transcript also has the following SNPs as listed in Table 553 (given according to their position on the nucleotide sequence, with the alternative nucleic acid listed; the last column indicates whether the SNP is known or not; the presence of known SNPs in variant protein M79217_PEA_1_P2 (SEQ ID NO:1337) sequence provides support for the deduced sequence of this variant protein according to the present invention).

TABLE 553

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 906 | T -> A | No |
| 1057 | A -> G | No |
| 1114 | A -> G | No |
| 1218 | C -> | No |
| 1220 | G -> A | No |
| 1359 | T -> G | No |
| 1889 | C -> | No |
| 1974 | A -> G | Yes |
| 2157 | T -> C | No |
| 2192 | C -> | No |

TABLE 553-continued

Nucleic acid SNPs

| SNP position on nucleotide sequence | Alternative nucleic acid | Previously known SNP? |
|---|---|---|
| 2306 | T -> G | No |
| 2864 | T -> C | Yes |
| 3026 | T -> C | No |
| 3047 | G -> T | No |
| 3060 | C -> | No |
| 3123 | C -> T | Yes |
| 3256 | A -> G | No |
| 3371 | A -> G | No |
| 3659 | C -> | No |
| 3659 | C -> T | No |
| 3724 | G -> A | No |
| 3725 | G -> A | No |
| 4054 | T -> A | No |
| 4224 | G -> A | Yes |
| 4410 | C -> T | No |
| 4748 | C -> T | Yes |
| 4857 | C -> T | Yes |
| 5075 | G -> A | No |
| 5283 | G -> A | No |
| 5381 | G -> A | Yes |
| 5525 | G -> T | Yes |
| 5781 | A -> C | No |
| 5915 | G -> | No |
| 5915 | G -> C | No |
| 5933 | C -> G | Yes |
| 5946 | T -> A | No |
| 6041 | G -> A | Yes |
| 6080 | G -> | No |
| 6133 | C -> T | No |

Variant protein M79217_PEA_1_P4 (SEQ ID NO:1338) according to the present invention has an amino acid sequence as given at the end of the application; it is encoded by transcript(s) M79217_PEA_1_T10 (SEQ ID NO:62). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison report between M79217_PEA_1_P4 (SEQ ID NO:1338) and EXL3_HUMAN (SEQ ID NO:1436):

1. An isolated chimeric polypeptide encoding for M79217_PEA_1_P4 (SEQ ID NO:1338), comprising a first amino acid sequence being at least 70%, optionally at least 80%, preferably at least 85%, more preferably at least 90% and most preferably at least 95% homologous to a polypeptide having the sequence PELRQPARLGLPECWDYRHEP-RCPAQMGSHFIVQAGLKLLASSKPPKCWDY (SEQ ID NO:1724) corresponding to amino acids 1-51 of M79217_PEA_1_P4 (SEQ ID NO:1338), and a second amino acid sequence being at least 90% homologous to RVWREARDRIVGFPGRYHAWDIPHQSWLYNSNYSC-ELSMVLTGAAFFHKYYAYLYSYVMPQAIRDMVD EYINCEDIAMNFLVSHITRKPPIKVTSRWTFRCPGC-PQALSHDDSHFHERHKCINFFVKVYGYMPLLYTQFR VDSVLFKTRLPHDKTKCFKFI corresponding to amino acids 759-919 of EXL3_HUMAN (SEQ ID NO:1436), which also corresponds to amino acids 52-212 of M79217_PEA_1_P4 (SEQ ID NO:1338), wherein said first amino acid sequence and second amino acid sequence are contiguous and in a sequential order.

2. An isolated polypeptide encoding for a head of M79217_PEA_1_P4 (SEQ ID NO:1338), comprising a polypeptide being at least 70%, optionally at least about 80%, preferably at least about 85%, more preferably at least about 90% and most preferably at least about 95% homologous to the sequence PELRQPARLGLPECWDYRHEPRC-PAQMGSHFIVQAGLKLLASSKPPKCWDY (Seq id no: 1724) of M79217_PEA_1_P4 (SEQ ID NO:1338).

The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein M79217_PEA_1_P4 (SEQ ID NO:1338) also has the following non-silent SNPs (Single Nucleotide Polymorphisms) as listed in Table 554, (given according to their position(s) on the amino acid sequence, with the alternative amino acid(s) listed; the last column indicates whether the SNP is known or not; the presence of known SNPs in variant protein M79217_PEA_1_P4 (SEQ ID NO:1338) sequence provides support for the deduced sequence of this variant protein according to the present invention).

TABLE 554

Amino acid mutations

| SNP position(s) on amino acid sequence | Alternative amino acid(s) | Previously known SNP? |
| --- | --- | --- |
| 53 | V -> A | No |
| 60 | R -> L | No |
| 64 | F -> | No |
| 142 | I -> V | No |
| 180 | Y -> C | No |

The glycosylation sites of variant protein M79217_PEA_1_P4 (SEQ ID NO:1338), as compared to the known protein Exostosin-like 3 (SEQ ID NO:1436), are described in Table 555 (given according to their position(s) on the amino acid sequence in the first column; the second column indicates whether the glycosylation site is present in the variant protein; and the last column indicates whether the position is different on the variant protein).

TABLE 555

Glycosylation site(s)

| Position(s) on known amino acid sequence | Present in variant protein? | Position in variant protein? |
| --- | --- | --- |
| 290 | no | |
| 592 | no | |
| 790 | yes | 83 |
| 277 | no | |

Variant protein M79217_PEA_1_P4 (SEQ ID NO:1338) is encoded by the following transcript(s): M79217_PEA_1_T10 (SEQ ID NO:62), for which the sequence(s) is/are given at the end of the application. The coding portion of transcript M79217_PEA_1_T10 (SEQ ID NO:62) is shown in bold; this coding portion starts at position 1 and ends at position 637. The transcript also has the following SNPs as listed in Table 556 (given according to their position on the nucleotide sequence, with the alternative nucleic acid listed; the last column indicates whether the SNP is known or not; the presence of known SNPs in variant protein M79217_PEA_1_P4 (SEQ ID NO:1338) sequence provides support for the deduced sequence of this variant protein according to the present invention).

TABLE 556

Nucleic acid SNPs

| SNP position on nucleotide sequence | Alternative nucleic acid | Previously known SNP? |
| --- | --- | --- |
| 159 | T -> C | No |
| 180 | G -> T | No |
| 193 | C -> | No |
| 256 | C -> T | Yes |
| 425 | A -> G | No |
| 540 | A -> G | No |
| 828 | C -> | No |
| 828 | C -> T | No |
| 893 | G -> A | No |
| 894 | G -> A | No |
| 1223 | T -> A | No |
| 1393 | G -> A | Yes |
| 1579 | C -> T | No |
| 1917 | C -> T | Yes |
| 2026 | C -> T | Yes |
| 2244 | G -> A | No |
| 2452 | G -> A | No |
| 2550 | G -> A | Yes |
| 2694 | G -> T | Yes |
| 2950 | A -> C | No |
| 3084 | G -> | No |
| 3084 | G -> C | No |
| 3102 | C -> G | Yes |
| 3115 | T -> A | No |
| 3210 | G -> A | Yes |
| 3249 | G -> | No |
| 3302 | C -> T | No |

Variant protein M79217_PEA_1_P8 (SEQ ID NO:1339) according to the present invention has an amino acid sequence as given at the end of the application; it is encoded by transcript(s) M79217_PEA_1_T15 (SEQ ID NO:63). An alignment is given to the known protein (Exostosin-like 3 (SEQ ID NO:1436)) at the end of the application. One or more alignments to one or more previously published protein sequences are given at the end of the application. A brief description of the relationship of the variant protein according to the present invention to each such aligned protein is as follows:

Comparison report between M79217_PEA_1_P8 (SEQ ID NO:1339) and EXL3_HUMAN (SEQ ID NO:1436):

1. An isolated chimeric polypeptide encoding for M79217_PEA_1_P8 (SEQ ID NO:1339), comprising a first amino acid sequence being at least 90% homologous to MTGYTMLRNGGAGNGGQTCMLRWSNRIRLTWLSF-TLFVILVFFPLIAHYYLTTLDEADEAGKRIFGPRVG NELCEVKHVLDLCRIRESVSEELLQLEAKRQELNS-EIAKLNLKIEACKKSIENAKQDLLQLKNVISQTEHSY KELMAQNQPKLSLPIRLLPEKDDAGLPPPKATRGC-RLHNCFDYSRCPLTSGFPVYVYDSDQFVFGSYLDPL VKQAFQATARANVYVTENADIACLYVILVGEMQE-PVVLRPAELEKQLYSLPHWRTDGHNHVIINLSRKSD TQNLLYNVSTGRAMVAQSTFYTVQYRPGFDLVVSP-LVHAMSEPNFMEIPPQVPVKRKYLFTFQGEKIESLR SSLQEARSFEEEMEGDPPADYDDRIIATLKAVQDS-KLDQVLVEFTCKNQPKPSLPTEWALCGEREDRLELL KLSTFALIITPGDPRLVISSGCATRLFEALEVGAVPVV-LGEQVQLPYQDMLQWNEAALVVPKPRVTEVHFL LRSLSDSDLLAMRRQGRFLWETYFSTADSIFNTVLA-MIRTRIQIPAAPIREEAAAEIPHRSGKAAGTDPNMA DNGDLDLGPVETEPPYASPRYLRNFTLTVTDFYRS-WNCAPGPFHLFPHTPFDPVLPSEAKFLGSGTGFRPIG GGAGGSGKEFQAALGGNVPREQFTVVMLTYEREE-
VLMNSLERLNGLPYLNKVVVVWNSPKLPSEDLLW
PDIGVPIMVVRTEKNSLNNRFLPWNEIETEAILSIDD-
DAHLRHDEIMFGFRVWREARDRIVGFPGRYHAWDI
PHQSWLYNSNYSCELSMVLTGAAFFHK corresponding to amino acids 1-807 of EXL3_HUMAN (SEQ ID NO:1436), which also corresponds to amino acids 1-807 of M79217_PEA_1_P8 (SEQ ID NO:1339), and a second amino acid sequence being at least 70%, optionally at least 80%, preferably at least 85%, more preferably at least 90% and most preferably at least 95% homologous to a polypeptide having the sequence VRKSW (SEQ ID NO: 1725) corresponding to amino acids 808-812 of M79217_PEA_1_P8 (SEQ ID NO:1339), wherein said first amino acid sequence and second amino acid sequence are contiguous and in a sequential order.

2. An isolated polypeptide encoding for a tail of M79217_PEA_1_P8 (SEQ ID NO:1339), comprising a polypeptide being at least 70%, optionally at least about 80%, preferably at least about 85%, more preferably at least about 90% and most preferably at least about 95% homologous to the sequence VRKSW (SEQ ID NO:1725) in M79217_PEA_1_P8 (SEQ ID NO:1339).

The location of the variant protein was determined according to results from a number of different software programs and analyses, including analyses from SignalP and other specialized programs. The variant protein is believed to be located as follows with regard to the cell: membrane. The protein localization is believed to be membrane because the Signalp_hmm software predicts that this protein has a signal anchor region.

Variant protein M79217_PEA_1_P8 (SEQ ID NO:1339) also has the following non-silent SNPs (Single Nucleotide Polymorphisms) as listed in Table 557, (given according to their position(s) on the amino acid sequence, with the alternative amino acid(s) listed; the last column indicates whether the SNP is known or not; the presence of known SNPs in variant protein M79217_PEA_1_P8 (SEQ ID NO:1339) sequence provides support for the deduced sequence of this variant protein according to the present invention).

TABLE 557

Amino acid mutations

| SNP position(s) on amino acid sequence | Alternative amino acid(s) | Previously known SNP? |
|---|---|---|
| 104 | N -> D | No |
| 123 | N -> D | No |
| 157 | I -> | No |
| 158 | R -> Q | No |
| 204 | F -> L | No |
| 381 | A -> | No |
| 482 | A -> | No |
| 520 | F -> C | No |
| 706 | L -> P | Yes |
| 760 | V -> A | No |
| 767 | R -> L | No |
| 771 | F -> | No |

The glycosylation sites of variant protein M79217_PEA_1_P8 (SEQ ID NO:1339), as compared to the known protein Exostosin-like 3 (SEQ ID NO:1436), are described in Table 558 (given according to their position(s) on the amino acid sequence in the first column; the second column indicates whether the glycosylation site is present in the variant protein; and the last column indicates whether the position is different on the variant protein).

TABLE 558

Glycosylation site(s)

| Position(s) on known amino acid sequence | Present in variant protein? | Position in variant protein? |
|---|---|---|
| 290 | yes | 290 |
| 592 | yes | 592 |
| 790 | yes | 790 |
| 277 | yes | 277 |

Variant protein M79217_PEA_1_P8 (SEQ ID NO:1339) is encoded by the following transcript(s): M79217_PEA_1_T15 (SEQ ID NO:63), for which the sequence(s) is/are given at the end of the application. The coding portion of transcript M79217_PEA_1_T15 (SEQ ID NO:63) is shown in bold; this coding portion starts at position 748 and ends at position 3183. The transcript also has the following SNPs as listed in Table 559 (given according to their position on the nucleotide sequence, with the alternative nucleic acid listed; the last column indicates whether the SNP is known or not; the presence of known SNPs in variant protein M79217_PEA_1_P8 (SEQ ID NO:1339) sequence provides support for the deduced sequence of this variant protein according to the present invention).

TABLE 559

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 906 | T -> A | No |
| 1057 | A -> G | No |
| 1114 | A -> G | No |
| 1218 | C -> | No |
| 1220 | G -> A | No |
| 1359 | T -> G | No |
| 1889 | C -> | No |
| 1974 | A -> G | Yes |
| 2157 | T -> C | No |
| 2192 | C -> | No |
| 2306 | T -> G | No |
| 2864 | T -> C | Yes |
| 3026 | T -> C | No |
| 3047 | G -> T | No |
| 3060 | C -> | No |
| 3123 | C -> T | Yes |
| 3391 | G -> T | No |
| 3560 | T -> C | No |

Variant protein M79217_PEA_1_P11 (SEQ ID NO:1340) according to the present invention has an amino acid sequence as given at the end of the application; it is encoded by transcript(s) M79217_PEA_1_T18 (SEQ ID NO:64). The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Signal peptide, NN:NO) predicts that this protein has a signal peptide.

Variant protein M79217_PEA_1_P11 (SEQ ID NO:1340) also has the following non-silent SNPs (Single Nucleotide Polymorphisms) as listed in Table 560, (given according to their position(s) on the amino acid sequence, with the alternative amino acid(s) listed; the last column indicates whether the SNP is known or not; the presence of known SNPs in variant protein M79217_PEA_1_P11 (SEQ ID NO:1340) sequence provides support for the deduced sequence of this variant protein according to the present invention).

TABLE 560

Amino acid mutations

| SNP position(s) on amino acid sequence | Alternative amino acid(s) | Previously known SNP? |
|---|---|---|
| 17 | P -> | No |
| 28 | C -> S | No |
| 72 | V -> | No |
| 90 | S -> F | No |

Variant protein M79217_PEA_1_P11 (SEQ ID NO:1340) is encoded by the following transcript(s): M79217_PEA_1_T18 (SEQ ID NO:64), for which the sequence(s) is/are given at the end of the application. The coding portion of transcript M79217_PEA_1_T18 (SEQ ID NO:64) is shown in bold; this coding portion starts at position 1354 and ends at position 1674. The transcript also has the following SNPs as listed in Table 561 (given according to their position on the nucleotide sequence, with the alternative nucleic acid listed; the last column indicates whether the SNP is known or not; the presence of known SNPs in variant protein M79217_PEA_1_P11 (SEQ ID NO:1340) sequence provides support for the deduced sequence of this variant protein according to the present invention).

TABLE 561

Nucleic acid SNPs

| SNP position on nucleotide sequence | Alternative nucleic acid | Previously known SNP? |
|---|---|---|
| 688 | C -> T | No |
| 689 | T -> | No |
| 746 | T -> C | No |
| 772 | G -> A | No |
| 870 | G -> A | Yes |
| 1014 | G -> T | Yes |
| 1270 | A -> C | No |
| 1404 | G -> | No |
| 1404 | G -> C | No |
| 1422 | C -> G | Yes |
| 1435 | T -> A | No |
| 1530 | G -> A | Yes |
| 1569 | G -> | No |
| 1622 | C -> T | No |

As noted above, cluster M79217 features 32 segment(s), which were listed in Table 548 above and for which the sequence(s) are given at the end of the application. These segment(s) are portions of nucleic acid sequence(s) which are described herein separately because they are of particular interest. A description of each segment according to the present invention is now provided.

Segment cluster M79217_PEA_1_node_2 (SEQ ID NO:584) according to the present invention is supported by 2 libraries. The number of libraries was determined as previously described. This segment can be found in the following transcript(s): M79217_PEA_1_T3 (SEQ ID NO:60). Table 562 below describes the starting and ending position of this segment on each transcript.

TABLE 562

Segment location on transcripts

| Transcript name | Segment starting position | Segment ending position |
|---|---|---|
| M79217_PEA_1_T3 (SEQ ID NO:60) | 50 | 177 |

Segment cluster M79217_PEA_1_node_4 (SEQ ID NO:585) according to the present invention is supported by 8 libraries. The number of libraries was determined as previously described. This segment can be found in the following transcript(s): M79217_PEA_1_T8 (SEQ ID NO:61), M79217_PEA_1_T15 (SEQ ID NO:63) and M79217_PEA_1_T18 (SEQ ID NO:64). Table 563 below describes the starting and ending position of this segment on each transcript.

TABLE 563

Segment location on transcripts

| Transcript name | Segment starting position | Segment ending position |
|---|---|---|
| M79217_PEA_1_T8 (SEQ ID NO:61) | 1 | 177 |
| M79217_PEA_1_T15 (SEQ ID NO:63) | 1 | 177 |
| M79217_PEA_1_T18 (SEQ ID NO:64) | 1 | 177 |

Segment cluster M79217_PEA_1_node_9 (SEQ ID NO:586) according to the present invention is supported by 2 libraries. The number of libraries was determined as previously described. This segment can be found in the following transcript(s): M79217_PEA_1_T1 (SEQ ID NO:59). Table 564 below describes the starting and ending position of this segment on each transcript.

TABLE 564

Segment location on transcripts

| Transcript name | Segment starting position | Segment ending position |
|---|---|---|
| M79217_PEA_1_T1 (SEQ ID NO:59) | 1 | 597 |

Segment cluster M79217_PEA_1_node_10 (SEQ ID NO:587) according to the present invention is supported by 33 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T15 (SEQ ID NO:63) and M79217_PEA_1_T18 (SEQ ID NO:64). Table 565 below describes the starting and ending position of this segment on each transcript.

TABLE 565

Segment location on transcripts

| Transcript name | Segment starting position | Segment ending position |
|---|---|---|
| M79217_PEA_1_T1 (SEQ ID NO:59) | 598 | 1080 |
| M79217_PEA_1_T3 (SEQ ID NO:60) | 272 | 754 |
| M79217_PEA_1_T8 (SEQ ID NO:61) | 272 | 754 |

TABLE 565-continued

Segment location on transcripts

| Transcript name | Segment starting position | Segment ending position |
|---|---|---|
| M79217_PEA_1_T15 (SEQ ID NO:63) | 272 | 754 |
| M79217_PEA_1_T18 (SEQ ID NO:64) | 272 | 754 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 566.

TABLE 566

Oligonucleotides related to this segment

| Oligonucleotide name | Overexpressed in cancers | Chip reference |
|---|---|---|
| M79217_0_9_0 (SEQ ID NO: 229) | lung malignant tumors | LUN |

Segment cluster M79217_PEA_1_node_11 (SEQ ID NO:588) according to the present invention is supported by 42 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 567 below describes the starting and ending position of this segment on each transcript.

TABLE 567

Segment location on transcripts

| Transcript name | Segment starting position | Segment ending position |
|---|---|---|
| M79217_PEA_1_T1 (SEQ ID NO:59) | 1081 | 1523 |
| M79217_PEA_1_T3 (SEQ ID NO:60) | 755 | 1197 |
| M79217_PEA_1_T8 (SEQ ID NO:61) | 755 | 1197 |
| M79217_PEA_1_T15 (SEQ ID NO:63) | 755 | 1197 |

Segment cluster M79217_PEA_1_node_13 (SEQ ID NO:589) according to the present invention is supported by 35 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 568 below describes the starting and ending position of this segment on each transcript.

TABLE 568

Segment location on transcripts

| Transcript name | Segment starting position | Segment ending position |
|---|---|---|
| M79217_PEA_1_T1 (SEQ ID NO:59) | 1548 | 2075 |
| M79217_PEA_1_T3 (SEQ ID NO:60) | 1222 | 1749 |
| M79217_PEA_1_T8 (SEQ ID NO:61) | 1222 | 1749 |
| M79217_PEA_1_T15 (SEQ ID NO:63) | 1222 | 1749 |

Segment cluster M79217_PEA_1_node_14 (SEQ ID NO:590) according to the present invention is supported by 65 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 569 below describes the starting and ending position of this segment on each transcript.

TABLE 569

Segment location on transcripts

| Transcript name | Segment starting position | Segment ending position |
|---|---|---|
| M79217_PEA_1_T1 (SEQ ID NO:59) | 2076 | 3221 |
| M79217_PEA_1_T3 (SEQ ID NO:60) | 1750 | 2895 |
| M79217_PEA_1_T8 (SEQ ID NO:61) | 1750 | 2895 |
| M79217_PEA_1_T15 (SEQ ID NO:63) | 1750 | 2895 |

Segment cluster M79217_PEA_1_node_16 (SEQ ID NO:591) according to the present invention is supported by 51 libraries. The number of libraries was determined as previously described. This segment can be found in the following transcript(s): M79217_PEA_1_T1 (SEQ ID NO:59), M79217_PEA_1_1T3 (SEQ ID NO:60), M79217_PEA_1_T8 (SEQ ID NO:61) and M79217_PEA_1_T15 (SEQ ID NO:63). Table 570 below describes the starting and ending position of this segment on each transcript.

TABLE 570

Segment location on transcripts

| Transcript name | Segment starting position | Segment ending position |
|---|---|---|
| M79217_PEA_1_T1 (SEQ ID NO:59) | 3222 | 3349 |
| M79217_PEA_1_T3 (SEQ ID NO:60) | 2896 | 3023 |
| M79217_PEA_1_T8 (SEQ ID NO:61) | 2896 | 3023 |
| M79217_PEA_1_T15 (SEQ ID NO:63) | 2896 | 3023 |

Segment cluster M79217_PEA_1_node_23 (SEQ ID NO:592) according to the present invention is supported by 50 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T15 (SEQ ID NO:63). Table 571 below describes the starting and ending position of this segment on each transcript.

TABLE 571

Segment location on transcripts

| Transcript name | Segment starting position | Segment ending position |
|---|---|---|
| M79217_PEA_1_T1 (SEQ ID NO:59) | 3350 | 3494 |
| M79217_PEA_1_T3 (SEQ ID NO:60) | 3024 | 3168 |
| M79217_PEA_1_T8 (SEQ ID NO:61) | 3024 | 3168 |
| M79217_PEA_1_T10 (SEQ ID NO:62) | 157 | 301 |
| M79217_PEA_1_T15 (SEQ ID NO:63) | 3024 | 3168 |

Segment cluster M79217_PEA_1_node_24 (SEQ ID NO:593) according to the present invention is supported by 2 libraries. The number of libraries was determined as previously described. This segment can be found in the following transcript(s): M79217_PEA_1_T15 (SEQ ID NO:63). Table 572 below describes the starting and ending position of this segment on each transcript.

TABLE 572

Segment location on transcripts

| Transcript name | Segment starting position | Segment ending position |
|---|---|---|
| M79217_PEA_1_T15 (SEQ ID NO:63) | 3169 | 3580 |

Segment cluster M79217_PEA_1_node_31 (SEQ ID NO:594) according to the present invention is supported by 50 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 573 below describes the starting and ending position of this segment on each transcript.

TABLE 573

Segment location on transcripts

| Transcript name | Segment starting position | Segment ending position |
|---|---|---|
| M79217_PEA_1_T1 (SEQ ID NO:59) | 3716 | 3960 |
| M79217_PEA_1_T3 (SEQ ID NO:60) | 3390 | 3634 |
| M79217_PEA_1_T8 (SEQ ID NO:61) | 3354 | 3598 |
| M79217_PEA_1_T10 (SEQ ID NO:62) | 523 | 767 |

Segment cluster M79217_PEA_1_node_33 (SEQ ID NO:595) according to the present invention is supported by 71 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 574 below describes the starting and ending position of this segment on each transcript.

TABLE 574

Segment location on transcripts

| Transcript name | Segment starting position | Segment ending position |
|---|---|---|
| M79217_PEA_1_T1 (SEQ ID NO:59) | 4015 | 4631 |
| M79217_PEA_1_T3 (SEQ ID NO:60) | 3689 | 4305 |
| M79217_PEA_1_T8 (SEQ ID NO:61) | 3653 | 4269 |
| M79217_PEA_1_T10 (SEQ ID NO:62) | 822 | 1438 |

Segment cluster M79217_PEA_1_node_34 (SEQ ID NO:596) according to the present invention is supported by 51 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 575 below describes the starting and ending position of this segment on each transcript.

TABLE 575

Segment location on transcripts

| Transcript name | Segment starting position | Segment ending position |
|---|---|---|
| M79217_PEA_1_T1 (SEQ ID NO:59) | 4632 | 4869 |
| M79217_PEA_1_T3 (SEQ ID NO:60) | 4306 | 4543 |
| M79217_PEA_1_T8 (SEQ ID NO:61) | 4270 | 4507 |
| M79217_PEA_1_T10 (SEQ ID NO:62) | 1439 | 1676 |

Segment cluster M79217_PEA_1_node_35 (SEQ ID NO:597) according to the present invention is supported by 53 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 576 below describes the starting and ending position of this segment on each transcript.

TABLE 576

Segment location on transcripts

| Transcript name | Segment starting position | Segment ending position |
|---|---|---|
| M79217_PEA_1_T1 (SEQ ID NO:59) | 4870 | 4997 |
| M79217_PEA_1_T3 (SEQ ID NO:60) | 4544 | 4671 |
| M79217_PEA_1_T8 (SEQ ID NO:61) | 4508 | 4635 |
| M79217_PEA_1_T10 (SEQ ID NO:62) | 1677 | 1804 |

Segment cluster M79217_PEA_1_node_37 (SEQ ID NO:598) according to the present invention is supported by 58 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 577 below describes the starting and ending position of this segment on each transcript.

TABLE 577

Segment location on transcripts

| Transcript name | Segment starting position | Segment ending position |
|---|---|---|
| M79217_PEA_1_T1 (SEQ ID NO:59) | 5039 | 5280 |
| M79217_PEA_1_T3 (SEQ ID NO:60) | 4713 | 4954 |
| M79217_PEA_1_T8 (SEQ ID NO:61) | 4677 | 4918 |
| M79217_PEA_1_T10 (SEQ ID NO:62) | 1846 | 2087 |

Segment cluster M79217_PEA_1_node_38 (SEQ ID NO:599) according to the present invention is supported by 62 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 578 below describes the starting and ending position of this segment on each transcript.

TABLE 578

Segment location on transcripts

| Transcript name | Segment starting position | Segment ending position |
|---|---|---|
| M79217_PEA_1_T1 (SEQ ID NO:59) | 5281 | 5436 |
| M79217_PEA_1_T3 (SEQ ID NO:60) | 4955 | 5110 |
| M79217_PEA_1_T8 (SEQ ID NO:61) | 4919 | 5074 |
| M79217_PEA_1_T10 (SEQ ID NO:62) | 2088 | 2243 |

Segment cluster M79217_PEA_1_node_41 (SEQ ID NO:600) according to the present invention is supported by 171 libraries. The number of libraries was determined as previously described. This segment can be found in the following transcript(s): M79217_PEA_1_T1 (SEQ ID NO:59), M79217_PEA_1_T3 (SEQ ID NO:60) M79217_PEA_1_T8 (SEQ ID NO:61), M79217_PEA_1_T10 (SEQ ID NO:62) and M79217_PEA_1_T18 (SEQ ID NO:64). Table 579 below describes the starting and ending position of this segment on each transcript.

TABLE 579

Segment location on transcripts

| Transcript name | Segment starting position | Segment ending position |
|---|---|---|
| M79217_PEA_1_T1 (SEQ ID NO:59) | 5628 | 6357 |
| M79217_PEA_1_T3 (SEQ ID NO:60) | 5302 | 6031 |
| M79217_PEA_1_T8 (SEQ ID NO:61) | 5266 | 5995 |
| M79217_PEA_1_T10 (SEQ ID NO:62) | 2435 | 3164 |
| M79217_PEA_1_T18 (SEQ ID NO:64) | 755 | 1484 |

Segment cluster M79217_PEA_1_node_44 (SEQ ID NO:601) according to the present invention is supported by 89 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 580 below describes the starting and ending position of this segment on each transcript.

TABLE 580

Segment location on transcripts

| Transcript name | Segment starting position | Segment ending position |
|---|---|---|
| M79217_PEA_1_T1 (SEQ ID NO:59) | 6472 | 6659 |
| M79217_PEA_1_T3 (SEQ ID NO:60) | 6146 | 6333 |
| M79217_PEA_1_T8 (SEQ ID NO:61) | 6110 | 6297 |
| M79217_PEA_1_T10 (SEQ ID NO:62) | 3279 | 3466 |
| M79217_PEA_1_T18 (SEQ ID NO:64) | 1599 | 1786 |

According to an optional embodiment of the present invention, short segments related to the above cluster are also provided. These segments are up to about 120 bp in length, and so are included in a separate description.

Segment cluster M79217_PEA_1_node_0 (SEQ ID NO:602) according to the present invention is supported by 4 libraries. The number of libraries was determined as previously described. This segment can be found in the following transcript(s): M79217_PEA_1_T3 (SEQ ID NO:60). Table 581 below describes the starting and ending position of this segment on each transcript.

TABLE 581

Segment location on transcripts

| Transcript name | Segment starting position | Segment ending position |
|---|---|---|
| M79217_PEA_1_T3 (SEQ ID NO:60) | 1 | 49 |

Segment cluster M79217_PEA_1_node_7 (SEQ ID NO:603) according to the present invention is supported by 11 libraries. The number of libraries was determined as previously described. This segment can be found in the following transcript(s): M79217_PEA_1_T3 (SEQ ID NO:60), M79217_PEA_1_T8 (SEQ ID NO:61), M79217_PEA_1_T15 (SEQ ID NO:63) and M79217_PEA_1_T18 (SEQ ID NO:64). Table 582 below describes the starting and ending position of this segment on each transcript.

TABLE 582

Segment location on transcripts

| Transcript name | Segment starting position | Segment ending position |
|---|---|---|
| M79217_PEA_1_T3 (SEQ ID NO:60) | 178 | 271 |
| M79217_PEA_1_T8 (SEQ ID NO:61) | 178 | 271 |
| M79217_PEA_1_T15 (SEQ ID NO:63) | 178 | 271 |
| M79217_PEA_1_T18 (SEQ ID NO:64) | 178 | 271 |

Segment cluster M79217_PEA_1_node_12 (SEQ ID NO:604) according to the present invention can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T15 (SEQ ID NO:63). Table 583 below describes the starting and ending position of this segment on each transcript.

TABLE 583

Segment location on transcripts

| Transcript name | Segment starting position | Segment ending position |
|---|---|---|
| M79217_PEA_1_T1 (SEQ ID NO:59) | 1524 | 1547 |
| M79217_PEA_1_T3 (SEQ ID NO:60) | 1198 | 1221 |
| M79217_PEA_1_T8 (SEQ ID NO:61) | 1198 | 1221 |
| M79217_PEA_1_T15 (SEQ ID NO:63) | 1198 | 1221 |

Segment cluster M79217_PEA_1_node_19 (SEQ ID NO:605) according to the present invention is supported by 1 libraries. The number of libraries was determined as previously described. This segment can be found in the following transcript(s): M79217_PEA_1_T10 (SEQ ID NO:62). Table 584 below describes the starting and ending position of this segment on each transcript.

TABLE 584

Segment location on transcripts

| Transcript name | Segment starting position | Segment ending position |
|---|---|---|
| M79217_PEA_1_T10 (SEQ ID NO:62) | 1 | 79 |

Segment cluster M79217_PEA_1_node_21 (SEQ ID NO:606) according to the present invention is supported by 1 libraries. The number of libraries was determined as previously described. This segment can be found in the following transcript(s): M79217_PEA_1_T10 (SEQ ID NO:62). Table 585 below describes the starting and ending position of this segment on each transcript.

TABLE 585

Segment location on transcripts

| Transcript name | Segment starting position | Segment ending position |
|---|---|---|
| M79217_PEA_1_T10 (SEQ ID NO:62) | 80 | 156 |

Segment cluster M79217_PEA_1_node_26 (SEQ ID NO:607) according to the present invention is supported by 40 libraries. The number of libraries was determined as previously described. This segment can be found in the following transcript(s): M79217_PEA_1_T1 (SEQ ID NO:59), M79217_PEA_1_T3 (SEQ ID NO:60) and M79217_PEA_1_T10 (SEQ ID NO:62). Table 586 below describes the starting and ending position of this segment on each transcript.

TABLE 586

Segment location on transcripts

| Transcript name | Segment starting position | Segment ending position |
|---|---|---|
| M79217_PEA_1_T1 (SEQ ID NO:59) | 3495 | 3530 |
| M79217_PEA_1_T3 (SEQ ID NO:60) | 3169 | 3204 |
| M79217_PEA_1_T10 (SEQ ID NO:62) | 302 | 337 |

Segment cluster M79217_PEA_1_node_27 (SEQ ID NO:608) according to the present invention is supported by 46 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 587 below describes the starting and ending position of this segment on each transcript.

TABLE 587

Segment location on transcripts

| Transcript name | Segment starting position | Segment ending position |
|---|---|---|
| M79217_PEA_1_T1 (SEQ ID NO:59) | 3531 | 3623 |
| M79217_PEA_1_T3 (SEQ ID NO:60) | 3205 | 3297 |
| M79217_PEA_1_T8 (SEQ ID NO:61) | 3169 | 3261 |
| M79217_PEA_1_T10 (SEQ ID NO:62) | 338 | 430 |

Segment cluster M79217_PEA_1_node_30 (SEQ ID NO:609) according to the present invention is supported by 47 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 588 below describes the starting and ending position of this segment on each transcript.

TABLE 588

Segment location on transcripts

| Transcript name | Segment starting position | Segment ending position |
|---|---|---|
| M79217_PEA_1_T1 (SEQ ID NO:59) | 3624 | 3715 |
| M79217_PEA_1_T3 (SEQ ID NO:60) | 3298 | 3389 |
| M79217_PEA_1_T8 (SEQ ID NO:61) | 3262 | 3353 |
| M79217_PEA_1_T10 (SEQ ID NO:62) | 431 | 522 |

Segment cluster M79217_PEA_1_node_32 (SEQ ID NO:610) according to the present invention is supported by 40 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 589 below describes the starting and ending position of this segment on each transcript.

TABLE 589

Segment location on transcripts

| Transcript name | Segment starting position | Segment ending position |
|---|---|---|
| M79217_PEA_1_T1 (SEQ ID NO:59) | 3961 | 4014 |
| M79217_PEA_1_T3 (SEQ ID NO:60) | 3635 | 3688 |
| M79217_PEA_1_T8 (SEQ ID NO:61) | 3599 | 3652 |
| M79217_PEA_1_T10 (SEQ ID NO:62) | 768 | 821 |

Segment cluster M79217_PEA_1_node_36 (SEQ ID NO:611) according to the present invention is supported by 42 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 590 below describes the starting and ending position of this segment on each transcript.

TABLE 590

Segment location on transcripts

| Transcript name | Segment starting position | Segment ending position |
|---|---|---|
| M79217_PEA_1_T1 (SEQ ID NO:59) | 4998 | 5038 |
| M79217_PEA_1_T3 (SEQ ID NO:60) | 4672 | 4712 |
| M79217_PEA_1_T8 (SEQ ID NO:61) | 4636 | 4676 |
| M79217_PEA_1_T10 (SEQ ID NO:62) | 1805 | 1845 |

Segment cluster M79217_PEA_1_node_39 (SEQ ID NO:612) according to the present invention is supported by 57 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 591 below describes the starting and ending position of this segment on each transcript.

TABLE 591

Segment location on transcripts

| Transcript name | Segment starting position | Segment ending position |
|---|---|---|
| M79217_PEA_1_T1 (SEQ ID NO:59) | 5437 | 5520 |
| M79217_PEA_1_T3 (SEQ ID NO:60) | 5111 | 5194 |
| M79217_PEA_1_T8 (SEQ ID NO:61) | 5075 | 5158 |
| M79217_PEA_1_T10 (SEQ ID NO:62) | 2244 | 2327 |

Segment cluster M79217_PEA_1_node_40 (SEQ ID NO:613) according to the present invention is supported by 59 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61) and M79217_PEA_1_T10 (SEQ ID NO:62). Table 592 below describes the starting and ending position of this segment on each transcript.

TABLE 592

Segment location on transcripts

| Transcript name | Segment starting position | Segment ending position |
|---|---|---|
| M79217_PEA_1_T1 (SEQ ID NO:59) | 5521 | 5627 |
| M79217_PEA_1_T3 (SEQ ID NO:60) | 5195 | 5301 |
| M79217_PEA_1_T8 (SEQ ID NO:61) | 5159 | 5265 |
| M79217_PEA_1_T10 (SEQ ID NO:62) | 2328 | 2434 |

Segment cluster M79217_PEA_1_node_42 (SEQ ID NO:614) according to the present invention is supported by 99 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64): Table 593 below describes the starting and ending position of this segment on each transcript.

TABLE 593

Segment location on transcripts

| Transcript name | Segment starting position | Segment ending position |
|---|---|---|
| M79217_PEA_1_T1 (SEQ ID NO:59) | 6358 | 6443 |
| M79217_PEA_1_T3 (SEQ ID NO:60) | 6032 | 6117 |
| M79217_PEA_1_T8 (SEQ ID NO:61) | 5996 | 6081 |
| M79217_PEA_1_T10 (SEQ ID NO:62) | 3165 | 3250 |

TABLE 593-continued

Segment location on transcripts

| Transcript name | Segment starting position | Segment ending position |
|---|---|---|
| M79217_PEA_1_T18 (SEQ ID NO:64) | 1485 | 1570 |

Segment cluster M79217_PEA_1_node_43 (SEQ ID NO:615) according to the present invention is supported by 90 libraries. The number of libraries was determined as previously described. This segment can be found in the following transcript(s): M79217_PEA_1_T1 (SEQ ID NO:59), M79217_PEA_1_T3 (SEQ ID NO:60), M79217_PEA_1_T8 (SEQ ID NO:61), M79217_PEA_1_T10 (SEQ ID NO:62) and M79217_PEA_1_T18 (SEQ ID NO:64). Table 594 below describes the starting and ending position of this segment on each transcript.

TABLE 594

Segment location on transcripts

| Transcript name | Segment starting position | Segment ending position |
|---|---|---|
| M79217_PEA_1_T1 (SEQ ID NO:59) | 6444 | 6471 |
| M79217_PEA_1_T3 (SEQ ID NO:60) | 6118 | 6145 |
| M79217_PEA_1_T8 (SEQ ID NO:61) | 6082 | 6109 |
| M79217_PEA_1_T10 (SEQ ID NO:62) | 3251 | 3278 |
| M79217_PEA_1_T18 (SEQ ID NO:64) | 1571 | 1598 |

Variant protein alignment to the previously known protein:

Sequence name: BAA25445 (SEQ ID NO:1437)

Sequence documentation:

Alignment of: M79217_PEA_1_P1 (SEQ ID NO:1336) x BAA25445 (SEQ ID NO:1437)

Alignment segment 1/1:

| Quality: | 9101.00 | Escore: | 0 |
|---|---|---|---|
| Matching length: | 919 | Total length: | 919 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MTGYTMLRNGGAGNGGQTCMLRWSNRIRLTWLSFTLFVILVFFPLIAHYY   50
    ||||||||||||||||||||||||||||||||||||||||||||||||||
  1 MTGYTMLRNGGAGNGGQTCMLRWSNRIRLTWLSFTLFVILVFFPLIAHYY   50

51 LTTLDEADEAGKRIFGPRVGNELCEVKHVLDLCRIRESVSEELLQLEAKR  100
    ||||||||||||||||||||||||||||||||||||||||||||||||||
 63 LTTLDEADEAGKRIFGPRVGNELCEVKHVLDLCRIRESVSEELLQLEAKR  112

101 QELNSEIAKLNLKIEACKKSIENAKQDLLQLKNVISQTEHSYKELMAQNQ  150
    ||||||||||||||||||||||||||||||||||||||||||||||||||
113 QELNSEIAKLNLKIEACKKSIENAKQDLLQLKNVISQTEHSYKELMAQNQ  162

151 PKLSLPIRLLPEKDDAGLPPPKATRGCRLHNCFDYSRCPLTSGFPVYVYD  200
    ||||||||||||||||||||||||||||||||||||||||||||||||||
163 PKLSLPIRLLPEKDDAGLPPPKATRGCRLHNCFDYSRCPLTSGFPVYVYD  212

201 SDQFVFGSYLDPLVKQAFQATARANVYVTENADIACLYVILVGEMQEPVV  250
    ||||||||||||||||||||||||||||||||||||||||||||||||||
213 SDQFVFGSYLDPLVKQAFQATARANVYVTENADIACLYVILVGEMQEPVV  262

251 LRPAELEKQLYSLPHWRTDGHNHVIINLSRKSDTQNLLYNVSTGRAMVAQ  300
    ||||||||||||||||||||||||||||||||||||||||||||||||||
263 LRPAELEKQLYSLPHWRTDGHNHVIINLSRKSDTQNLLYNVSTGRAMVAQ  312

301 STFYTVQYRPGFDLVVSPLVHAMSEPNFMEIPPQVPVKRKYLFTFQGEKI  350
    ||||||||||||||||||||||||||||||||||||||||||||||||||
313 STFYTVQYRPGFDLVVSPLVHAMSEPNFMEIPPQVPVKRKYLFTFQGEKI  362

351 ESLRSSLQEARDFEEEMEGDPPADYDDRIIATLKAVQDSKLDQVLVEFTC  400
    ||||||||||||||||||||||||||||||||||||||||||||||||||
363 ESLRSSLQEARDFEEEMEGDPPADYDDRIIATLKAVQDSKLDQVLVEFTC  412

401 KNQPKPSLPTEWALCGEREDRLELLKLSTFALIITPGDPRLVISSGCATR  450
    ||||||||||||||||||||||||||||||||||||||||||||||||||
413 KNQPKPSLPTEWALCGEREDRLELLKLSTFALIITPGDPRLVISSGCATR  462

451 LFEALEVGAVPVVLGEQVQLPYQDMLQWNEAALVVPKPRVTEVHFLLRSL  500
    ||||||||||||||||||||||||||||||||||||||||||||||||||
463 LFEALEVGAVPVVLGEQVQLPYQDMLQWNEAALVVPKPRVTEVHFLLRSL  512
```

-continued

```
501  SDSDLLAMRRQGRFLWETYFSTADSIFNTVLAMIRTRIQIPAAPIREEAA  550
     ||||||||||||||||||||||||||||||||||||||||||||||||||
513  SDSDLLAMRRQGRFLWETYFSTADSIFNTVLAMIRTRIQIPAAPIREEAA  562

551  AEIPHRSGKAAGTDPNMADNGDLDLGPVETEPPYASPRYLRNFTLTVTDF   600
     |||||||||||||||||||||||||||||||||||||||||||||||||
563  AEIPHRSGKAAGTDPNMADNGDLDLGPVETEPPYASPRYLRNFTLTVTDF   612

601  YRSWNCAPGPFHLFPHTPFDPVLPSEAKFLGSGTGFRPIGGGAGGSGKEF   650
     |||||||||||||||||||||||||||||||||||||||||||||||||
613  YRSWNCAPGPFHLFPHTPFDPVLPSEAKFLGSGTGFRPIGGGAGGSGKEF   662

651  QAALGGNVPREQFTVVMLTYEREEVLMNSLERLNGLPYLNKVVVVWNSPK   700
     |||||||||||||||||||||||||||||||||||||||||||||||||
663  QAALGGNVPREQFTVVMLTYEREEVLMNSLERLNGLPYLNKVVVVWNSPK   712

701  LPSEDLLWPDIGVPIMVVRTEKNSLNNRFLPWNEIETEAILSIDDDAHLR   750
     |||||||||||||||||||||||||||||||||||||||||||||||||
713  LPSEDLLWPDIGVPIMVVRTEKNSLNNRFLPWNEIETEAILSIDDDAHLR   762

751  HDEIMFGFRVWREARDRIVGFPGRYHAWDIPHQSWLYNSNYSCELSMVLT   800
     |||||||||||||||||||||||||||||||||||||||||||||||||
763  HDEIMFGFRVWREARDRIVGFPGRYHAWDIPHQSWLYNSNYSCELSMVLT   812

801  GAAFFHKYYAYLYSYVMPQAIRDMVDEYINCEDIAMNFLVSHITRKPPIK   850
     |||||||||||||||||||||||||||||||||||||||||||||||||
813  GAAFFHKYYAYLYSYVMPQAIRDMVDEYINCEDIAMNFLVSHITRKPPIK   862

851  VTSRWTFRCPGCPQALSHDDSHFHERHKCINFFVKVYGYMPLLYTQFRVD   900
     |||||||||||||||||||||||||||||||||||||||||||||||||
863  VTSRWTFRCPGCPQALSHDDSHFHERHKCINFFVKVYGYMPLLYTQFRVD   912

901  SVLFKTRLPHDKTKCFKFI                                 919
     |||||||||||||||||||
913  SVLFKTRLPHDKTKCFKFI                                 931
```

Sequence name: EXL3_HUMAN (SEQ ID NO:1436)

Sequence documentation:

Alignment of: M79217_PEA_1_P2 (SEQ ID NO:1337) x EXL3_HUMAN (SEQ ID NO:1436)

Alignment segment 1/1:

| | | | |
|---|---|---|---|
| Quality: | 8873.00 | Escore: | 0 |
| Matching length: | 907 | Total length: | 919 |
| Matching Percent Similarity: | 100.00 | Matching Percent Identity: | 100.00 |
| Total Percent Similarity: | 98.69 | Total Percent Identity: | 98.69 |
| Gaps: | 1 | | |

Alignment:

```
1    MTGYTMLRNGGAGNGGQTCMLRWSNRIRLTWLSFTLFVILVFFPLIAHYY   50
     ||||||||||||||||||||||||||||||||||||||||||||||||||
1    MTGYTMLRNGGAGNGGQTCMLRWSNRIRLTWLSFTLFVILVFFPLIAHYY   50

51   LTTLDEADEAGKRIFGPRVGNELCEVKHVLDLCRIRESVSEELLQLEAKR   100
     |||||||||||||||||||||||||||||||||||||||||||||||||
63   LTTLDEADEAGKRIFGPRVGNELCEVKHVLDLCRIRESVSEELLQLEAKR   112

101  QELNSEIAKLNLKIEACKKSIENAKQDLLQLKNVISQTEHSYKELMAQNQ   150
     |||||||||||||||||||||||||||||||||||||||||||||||||
113  QELNSEIAKLNLKIEACKKSIENAKQDLLQLKNVISQTEHSYKELMAQNQ   162

151  PKLSLPIRLLPEKDDAGLPPPKATRGCRLHNCFDYSRCPLTSGFPVYVYD   200
     |||||||||||||||||||||||||||||||||||||||||||||||||
163  PKLSLPIRLLPEKDDAGLPPPKATRGCRLHNCFDYSRCPLTSGFPVYVYD   212

201  SDQFVFGSYLDPLVKQAFQATARANVYVTENADIACLYVILVGEMQEPVV   250
     |||||||||||||||||||||||||||||||||||||||||||||||||
213  SDQFVFGSYLDPLVKQAFQATARANVYVTENADIACLYVILVGEMQEPVV   262

251  LRPAELEKQLYSLPHWRTDGHNHVIINLSRKSDTQNLLYNVSTGRAMVAQ   300
     |||||||||||||||||||||||||||||||||||||||||||||||||
263  LRPAELEKQLYSLPHWRTDGHNHVIINLSRKSDTQNLLYNVSTGRAMVAQ   312
```

-continued

```
301  STFYTVQYRPGFDLVVSPLVHAMSEPNFMEIPPQVPVKRKYLFTFQGEKI  350
     |||||||||||||||||||||||||||||||||||||||||||||||||
313  STFYTVQYRPGFDLVVSPLVHAMSEPNFMEIPPQVPVKRKYLFTFQGEKI  362

351  ESLRSSLQEARDFEEEMEGDPPADYDDRIIATLKAVQDSKLDQVLVEFTC  400
     |||||||||||||||||||||||||||||||||||||||||||||||||
351  ESLRSSLQEARDFEEEMEGDPPADYDDRIIATLKAVQDSKLDQVLVEFTC  400

401  KNQPKPSLPTEWALCGEREDRLELLKLSTFALIITPGDPRLVISSGCATR  450
     |||||||||||||||||||||||||||||||||||||||||||||||||
401  KNQPKPSLPTEWALCGEREDRLELLKLSTFALIITPGDPRLVISSGCATR  450

451  LFEALEVGAVPVVLGEQVQLPYQDMLQWNEAALVVPKPRVTEVHFLLRSL  500
     |||||||||||||||||||||||||||||||||||||||||||||||||
451  LFEALEVGAVPVVLGEQVQLPYQDMLQWNEAALVVPKPRVTEVHFLLRSL  500

501  SDSDLLAMRRQGRFLWETYFSTADSIFNTVLAMIRTRIQIPAAPIREEAA  550
     |||||||||||||||||||||||||||||||||||||||||||||||||
501  SDSDLLAMRRQGRFLWETYFSTADSIFNTVLAMIRTRIQIPAAPIREEAA  550

551  AEIPHRSGKAAGTDPNMADNGDLDLGPVETEPPYASPRYLRNFTLTVTDF  600
     |||||||||||||||||||||||||||||||||||||||||||||||||
551  AEIPHRSGKAAGTDPNMADNGDLDLGPVETEPPYASPRYLRNFTLTVTDF  600

601  YRSWNCAPGPFHLFPHTPFDPVLPSEAKFLGSGTGFRPIGGGAGGSGKEF  650
     |||||||||||||||||||||||||||||||||||||||||||||||||
601  YRSWNCAPGPFHLFPHTPFDPVLPSEAKFLGSGTGFRPIGGGAGGSGKEF  650

651  QAALGGNVPREQFTVVMLTYEREEVLMNSLERLNGLPYLNKVVVVWNSPK  700
     |||||||||||||||||||||||||||||||||||||||||||||||||
651  QAALGGNVPREQFTVVMLTYEREEVLMNSLERLNGLPYLNKVVVVWNSPK  700

701  LPSEDLLWPDIGVPIMVVRTEKNSLNNRFLPWNEIETEAILSIDDDAHLR  750
     |||||||||||||||||||||||||||||||||||||||||||||||||
713  LPSEDLLWPDIGVPIMVVRTEKNSLNNRFLPWNEIETEAILSIDDDAHLR  750

751  HDEIMFGFRVWREARDRIVGFPGRYHAWDIPHQSWLYNSNYSCELSMVLT  800
     |||||||||||||||||||||||||||||||||||||||||||||||||
751  HDEIMFGFRVWREARDRIVGFPGRYHAWDIPHQSWLYNSNYSCELSMVLT  800

801  GAAFFHK............AIRDMVDEYINCEDIAMNFLVSHITRKPPIK  838
     |||||||             |||||||||||||||||||||||||||||
801  GAAFFHKYYAYLYSYVMPQAIRDMVDEYINCEDIAMNFLVSHITRKPPIK  850

839  VTSRWTFRCPGCPQALSHDDSHFHERHKCINFFVKVYGYMPLLYTQFRVD  888
     |||||||||||||||||||||||||||||||||||||||||||||||||
851  VTSRWTFRCPGCPQALSHDDSHFHERHKCINFFVKVYGYMPLLYTQFRVD  900

851  SVLFKTRLPHDKTKCFKFI  907
     |||||||||||||||||||
901  SVLFKTRLPHDKTKCFKFI  919
```

Sequence name: EXL3_HUMAN (SEQ ID NO:1436)
Sequence documentation:
Alignment of: M79217_PEA_1_P4 (SEQ ID NO:1338) x EXL3 HUMAN (SEQ ID NO:1436)
Alignment segment 1/1:

| Quality: | 1668.00 | Escore: | 0 |
|---|---|---|---|
| Matching length: | 162 | Total length: | 162 |

-continued

| Matching Percent Similarity: | 100.00 | Matching Percent Identity: | 99.38 |
|---|---|---|---|
| Total Percent Similarity: | 100.00 | Total Percent Identity: | 99.38 |
| Gaps: | 0 | | |

Alignment:

```
 51  YRVWREARDRIVGFPGRYHAWDIPHQSWLYNSNYSCELSMVLTGAAFFHK  100
     :||||||||||||||||||||||||||||||||||||||||||||||||
758  FRVWREARDRIVGFPGRYHAWDIPHQSWLYNSNYSCELSMVLTGAAFFHK  807

101  YYAYLYSYVMPQAIRDMVDEYINCEDIAMNFLVSHITRKPPIKVTSRWTF  150
     |||||||||||||||||||||||||||||||||||||||||||||||||
808  YYAYLYSYVMPQAIRDMVDEYINCEDIAMNFLVSHITRKPPIKVTSRWTF  857

151  RCPGCPQALSHDDSHFHERHKCINFFVKVYGYMPLLYTQFRVDSVLFKTR  200
     |||||||||||||||||||||||||||||||||||||||||||||||||
858  RCPGCPQALSHDDSHFHERHKCINFFVKVYGYMPLLYTQFRVDSVLFKTR  907
```

-continued

```
201  LPHDKTKCFKFI                                         212
     ||||||||||||
908  LPHDKTKCFKFI                                         919
```

Sequence name: EXL3_HUMAN (SEQ ID NO:1436)
Sequence documentation:
Alignment of: M79217_PEA__1_P8 (SEQ ID NO:1339) x EXL3_HUMAN (SEQ ID NO:1436)
Alignment segment 1/1:

| Quality: | 7947.00 | Escore: | 0 |
|---|---|---|---|
| Matching length: | 807 | Total length: | 807 |

-continued

| Matching Percent Similarity: | 100.00 | Matching Percent Identity: | 100.00 |
|---|---|---|---|
| Total Percent Similarity: | 100.00 | Total Percent Identity: | 100.00 |
| Gaps: | 0 | | |

Alignment:

```
  1  MTGYTMLRNGGAGNGGQTCMLRWSNRIRLTWLSFTLFVILVFFPLIAHYY   50
     ||||||||||||||||||||||||||||||||||||||||||||||||||
  1  MTGYTMLRNGGAGNGGQTCMLRWSNRIRLTWLSFTLFVILVFFPLIAHYY   50

51  LTTLDEADEAGKRIFGPRVGNELCEVKHVLDLCRIRESVSEELLQLEAKR  100
     |||||||||||||||||||||||||||||||||||||||||||||||||
 63  LTTLDEADEAGKRIFGPRVGNELCEVKHVLDLCRIRESVSEELLQLEAKR  112

101  QELNSEIAKLNLKIEACKKSIENAKQDLLQLKNVISQTEHSYKELMAQNQ  150
     |||||||||||||||||||||||||||||||||||||||||||||||||
101  QELNSEIAKLNLKIEACKKSIENAKQDLLQLKNVISQTEHSYKELMAQNQ  150

151  PKLSLPIRLLPEKDDAGLPPPKATRGCRLHNCFDYSRCPLTSGFPVYVYD  200
     |||||||||||||||||||||||||||||||||||||||||||||||||
151  PKLSLPIRLLPEKDDAGLPPPKATRGCRLHNCFDYSRCPLTSGFPVYVYD  200

201  SDQFVFGSYLDPLVKQAFQATARANVYVTENADIACLYVILVGEMQEPVV  250
     |||||||||||||||||||||||||||||||||||||||||||||||||
201  SDQFVFGSYLDPLVKQAFQATARANVYVTENADIACLYVILVGEMQEPVV  250

251  LRPAELEKQLYSLPHWRTDGHNHVIINLSRKSDTQNLLYNVSTGRAMVAQ  300
     |||||||||||||||||||||||||||||||||||||||||||||||||
251  LRPAELEKQLYSLPHWRTDGHNHVIINLSRKSDTQNLLYNVSTGRAMVAQ  300

301  STFYTVQYRPGFDLVVSPLVHAMSEPNFMEIPPQVPVKRKYLFTFQGEKI  350
     |||||||||||||||||||||||||||||||||||||||||||||||||
301  STFYTVQYRPGFDLVVSPLVHAMSEPNFMEIPPQVPVKRKYLFTFQGEKI  350

351  ESLRSSLQEARDFEEEMEGDPPADYDDRIIATLKAVQDSKLDQVLVEFTC  400
     |||||||||||||||||||||||||||||||||||||||||||||||||
351  ESLRSSLQEARDFEEEMEGDPPADYDDRIIATLKAVQDSKLDQVLVEFTC  400

401  KNQPKPSLPTEWALCGEREDRLELLKLSTFALIITPGDPRLVISSGCATR  450
     |||||||||||||||||||||||||||||||||||||||||||||||||
401  KNQPKPSLPTEWALCGEREDRLELLKLSTFALIITPGDPRLVISSGCATR  450

451  LFEALEVGAVPVVLGEQVQLPYQDMLQWNEAALVVPKPRVTEVHFLLRSL  500
     |||||||||||||||||||||||||||||||||||||||||||||||||
451  LFEALEVGAVPVVLGEQVQLPYQDMLQWNEAALVVPKPRVTEVHFLLRSL  500

501  SDSDLLAMRRQGRFLWETYFSTADSIFNTVLAMIRTRIQIPAAPIREEAA  550
     |||||||||||||||||||||||||||||||||||||||||||||||||
501  SDSDLLAMRRQGRFLWETYFSTADSIFNTVLAMIRTRIQIPAAPIREEAA  550

551  AEIPHRSGKAAGTDPNMADNGDLDLGPVETEPPYASPRYLRNFTLTVTDF  600
     |||||||||||||||||||||||||||||||||||||||||||||||||
551  AEIPHRSGKAAGTDPNMADNGDLDLGPVETEPPYASPRYLRNFTLTVTDF  600

601  YRSWNCAPGPFHLFPHTPFDPVLPSEAKFLGSGTGFRPIGGGAGGSGKEF  650
     |||||||||||||||||||||||||||||||||||||||||||||||||
601  YRSWNCAPGPFHLFPHTPFDPVLPSEAKFLGSGTGFRPIGGGAGGSGKEF  650

651  QAALGGNVPREQFTVVMLTYEREEVLMNSLERLNGLPYLNKVVVVWNSPK  700
     |||||||||||||||||||||||||||||||||||||||||||||||||
651  QAALGGNVPREQFTVVMLTYEREEVLMNSLERLNGLPYLNKVVVVWNSPK  700
```

-continued

```
701  LPSEDLLWPDIGVPIMVVRTEKNSLNNRFLPWNEIETEAILSIDDDAHLR  750
     ||||||||||||||||||||||||||||||||||||||||||||||||||
701  LPSEDLLWPDIGVPIMVVRTEKNSLNNRFLPWNEIETEAILSIDDDAHLR  750

751  HDEIMFGFRVWREARDRIVGFPGRYHAWDIPHQSWLYNSNYSCELSMVLT  800
     |||||||||||||||||||||||||||||||||||||||||||||||||
751  HDEIMFGFRVWREARDRIVGFPGRYHAWDIPHQSWLYNSNYSCELSMVLT  800

801  GAAFFHK  807
     |||||||
801  GAAFFHK  807
```

Description for Cluster M62096

Cluster M62096 features 9 transcript(s) and 42 segment(s) of interest, the names for which are given in Tables 595 and 596, respectively, the sequences themselves are given at the end of the application. The selected protein variants are given in table 597.

TABLE 595

Transcripts of interest

| Transcript Name | Sequence ID No. |
|---|---|
| M62096_PEA_1_T4 | 65 |
| M62096_PEA_1_T5 | 66 |
| M62096_PEA_1_T6 | 67 |
| M62096_PEA_1_T7 | 68 |
| M62096_PEA_1_T9 | 69 |
| M62096_PEA_1_T11 | 70 |
| M62096_PEA_1_T13 | 71 |
| M62096_PEA_1_T14 | 72 |
| M62096_PEA_1_T15 | 73 |

TABLE 596

Segments of interest

| Segment Name | Sequence ID No. |
|---|---|
| M62096_PEA_1_node_0 | 616 |
| M62096_PEA_1_node_2 | 617 |
| M62096_PEA_1_node_15 | 618 |
| M62096_PEA_1_node_17 | 619 |
| M62096_PEA_1_node_19 | 620 |
| M62096_PEA_1_node_23 | 621 |
| M62096_PEA_1_node_27 | 623 |
| M62096_PEA_1_node_29 | 624 |
| M62096_PEA_1_node_31 | 625 |
| M62096_PEA_1_node_34 | 626 |
| M62096_PEA_1_node_36 | 627 |
| M62096_PEA_1_node_38 | 628 |
| M62096_PEA_1_node_40 | 629 |
| M62096_PEA_1_node_48 | 630 |
| M62096_PEA_1_node_50 | 631 |
| M62096_PEA_1_node_56 | 632 |
| M62096_PEA_1_node_60 | 633 |
| M62096_PEA_1_node_65 | 634 |
| M62096_PEA_1_node_69 | 635 |
| M62096_PEA_1_node_71 | 636 |
| M62096_PEA_1_node_1 | 637 |
| M62096_PEA_1_node_4 | 638 |
| M62096_PEA_1_node_6 | 639 |
| M62096_PEA_1_node_7 | 640 |
| M62096_PEA_1_node_9 | 641 |
| M62096_PEA_1_node_11 | 642 |
| M62096_PEA_1_node_13 | 643 |
| M62096_PEA_1_node_21 | 644 |
| M62096_PEA_1_node_25 | 645 |
| M62096_PEA_1_node_33 | 646 |
| M62096_PEA_1_node_42 | 647 |

TABLE 596-continued

Segments of interest

| Segment Name | Sequence ID No. |
|---|---|
| M62096_PEA_1_node_44 | 648 |
| M62096_PEA_1_node_47 | 649 |
| M62096_PEA_1_node_51 | 650 |
| M62096_PEA_1_node_53 | 651 |
| M62096_PEA_1_node_55 | 652 |
| M62096_PEA_1_node_58 | 653 |
| M62096_PEA_1_node_62 | 654 |
| M62096_PEA_1_node_66 | 655 |
| M62096_PEA_1_node_67 | 656 |
| M62096_PEA_1_node_68 | 657 |
| M62096_PEA_1_node_70 | 658 |

TABLE 597

Proteins of interest

| Protein Name | Sequence ID No. | Corresponding Transcript(s) |
|---|---|---|
| M62096_PEA_1_P4 | 1341 | M62096_PEA_1_T6 (SEQ ID NO:67) |
| M62096_PEA_1_P5 | 1342 | M62096_PEA_1_T7 (SEQ ID NO:68) |
| M62096_PEA_1_P3 | 1343 | M62096_PEA_1_T9 (SEQ ID NO:69) |
| M62096_PEA_1_P7 | 1344 | M62096_PEA_1_T11 (SEQ ID NO:70) |
| M62096_PEA_1_P8 | 1345 | M62096_PEA_1_T13 (SEQ ID NO:71) |
| M62096_PEA_1_P9 | 1346 | M62096_PEA_1_T14 (SEQ ID NO:72) |
| M62096_PEA_1_P10 | 1347 | M62096_PEA_1_T15 (SEQ ID NO:73) |
| M62096_PEA_1_P11 | 1348 | M62096_PEA_1_T4 (SEQ ID NO:65) |
| M62096_PEA_1_P12 | 1349 | M62096_PEA_1_T5 (SEQ ID NO:66) |

These sequences are variants of the known protein Kinesin heavy chain isoform 5C (SwissProt accession identifier KF5C_HUMAN; known also according to the synonyms Kinesin heavy chain neuron-specific 2), SEQ ID NO: 1438, referred to herein as the previously known protein.

Protein Kinesin heavy chain isoform 5C (SEQ ID NO:1438) is known or believed to have the following function(s): Kinesin is a microtubule-associated force-producing protein that may play a role in organelle transport. The sequence for protein Kinesin heavy chain isoform 5C is given at the end of the application, as "Kinesin heavy chain isoform 5C amino acid sequence". Known polymorphisms for this sequence are as shown in Table 598.

TABLE 598

Amino acid mutations for Known Protein

| SNP position(s) on amino acid sequence | Comment |
|---|---|
| 355-360 | TLKNVI -> STHASV |
| 583-585 | EFT -> DRV |

The following GO Annotation(s) apply to the previously known protein. The following annotation(s) were found: organelle organization and biogenesis, which are annotation(s) related to Biological Process; microtubule motor; ATP binding, which are annotation(s) related to Molecular Function; and kinesin, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster M62096 features 9 transcript(s), which were listed in Table 595 above. These transcript(s) encode for protein(s) which are variant(s) of protein Kinesin heavy chain isoform 5C (SEQ ID NO:1438). A description of each variant protein according to the present invention is now provided.

Variant protein M62096_PEA_1_P4 (SEQ ID NO:1341) according to the present invention has an amino acid sequence as given at the end of the application; it is encoded by transcript(s) M62096_PEA_1_T6 (SEQ ID NO:67). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P4 (SEQ ID NO:1341) and KF5C_HUMAN (SEQ ID NO:1438):

1. An isolated chimeric polypeptide encoding for M62096_PEA_1_P4 (SEQ ID NO:1341), comprising a first amino acid sequence being at least 70%, optionally at least 80%, preferably at least 85%, more preferably at least 90% and most preferably at least 95% homologous to a polypeptide having the sequence MATYIH (SEQ ID NO:1726) corresponding to amino acids 1-6 of M62096_PEA_1_P4 (SEQ ID NO:1341), and a second amino acid sequence being at least 90% homologous to VSKTGAEGAVLDEAKNINK-SLSALGNVISALAEGTKTHVPYRDSK-MTRILQDSLGGNCRTTIVICCSPSVFN EAETKSTLMF-GQRAKTIKNTVSVNLELTAEEWKKKYEKEKEKNKT-LKNVIQHLEMELNRWRNGEAVPED EQISAKDQKN-LEPCDNTPIIDNIAPVVAGISTEEKEKY-DEEISSLYRQLDDKDDEINQQSQLAEKLKQQMLD QDELLASTRRDYEKIQEELTRLQIENE-AAKDEVKEVLQALEELAVNYDQK-SQEVEDKTRANEQLTDELAQ KTTTLTTTQRELS-QLQELSNHQKKRATEILNLLLKDLGEIG-GIIGTNDVKTLADVNGVIEEEFTMARLYISK MKSEVKSLVNRSKQLESAQMDSNRKM-NASERELAACQLLISQHEAKIKSLTDYM-QNMEQKRRQLEESQD SLSEELAKLRAQEKMHEVS-FQDKEKEHLTRLQDAEEMKKALEQQMESHREAHQK-QLSRLRDEIEEKQKII DEIRDLNQKLQLEQEKLSS-DYNKLKIEDQEREMKLEKLLLLND-KREQAREDLKGLEETVSRELQTLHNLR KLFVQDLT-TRVKKSVELDNDDGGGSAAQKQKISFLENNLEQLTK-VHKQLVRDNADLRCELPKLEKRLRA TAERVKALE-SALKEAKENAM-RDRKRYQQEVDRIKEAVRAKNMARRAH-SAQIAKPIRPGHYPASSPTAVH AIRGGGGSSSNSTHYQK corresponding to amino acids 239-957 of KF5C_HUMAN (SEQ ID NO:1438), which also corresponds to amino acids 7-725 of M62096_PEA_1_P4 (SEQ ID NO:1341), wherein said first amino acid sequence and second amino acid sequence are contiguous and in a sequential order.

2. An isolated polypeptide encoding for a head of M62096_PEA_1_P4 (SEQ ID NO:1341), comprising a polypeptide being at least 70%, optionally at least about 80%, preferably at least about 85%, more preferably at least about 90% and most preferably at least about 95% homologous to the sequence MATYIH (SEQ ID NO:1726) of M62096_PEA_1_P4 (SEQ ID NO:1341).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P4 (SEQ ID NO:1341) is encoded by the following transcript(s): M62096_PEA_1_T6 (SEQ ID NO:67), for which the sequence(s) is/are given at the end of the application. The coding portion of transcript M62096_PEA_1_T6 (SEQ ID NO:67) is shown in bold; this coding portion starts at position 108 and ends at position 2282. The transcript also has the following SNPs as listed in Table 599 (given according to their position on the nucleotide sequence, with the alternative nucleic acid listed; the last column indicates whether the SNP is known or not; the presence of known SNPs in variant protein M62096_PEA_1_P4 (SEQ ID NO:1341) sequence provides support for the deduced sequence of this variant protein according to the present invention).

TABLE 599

Nucleic acid SNPs

| SNP position on nucleotide sequence | Alternative nucleic acid | Previously known SNP? |
|---|---|---|
| 5757 | G -> T | No |

Variant protein M62096_PEA_1_P5 (SEQ ID NO:1342) according to the present invention has an amino acid sequence as given at the end of the application; it is encoded by transcript(s) M62096_PEA_1_T7 (SEQ ID NO:68). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P5 (SEQ ID NO:1342) and KF5C_HUMAN (SEQ ID NO:1438)

1. An isolated chimeric polypeptide encoding for M62096_PEA_1_P5 (SEQ ID NO:1342), comprising a first amino acid sequence being at least 90% homologous to MTRILQDSLGGNCRTTIVICCSPS-VFNEAETKSTLMFGQRAKTIKNTVSVN-LELTAEEWKKKYEKEKEKNK TLKNVIQHLEMELNR-WRNGEAVPEDEQISAKDQKNLEPCDNTPIIDNIAPVV-AGISTEEKEKYDEEISSLYR QLDDKDDEIN-QQSQLAEKLKQQMLDQDELLASTR-RDYEKIQEELTRLQIENEAAKDEVKEVLQALEELAV NYDQKSQEVEDKTRANEQLTDELAQKT-FTLTTTQRELSQLQELSN-HQKKRATEILNLLLKDLGEIGGIIGT NDVKTLAD-VNGVIEEEFTMARLYISKMKSEVKSLVNRSKQLESA-QMDSNRKMNASERELAACQLLISQHE AKIKSLT-DYMQNMEQKRRQLEESQDSLSEELAKL-RAQEKMHEVSFQDKEKEHLTRLQDAEEMKKALEQQ MESHREAHQKQLSRLRDEIEEKQKII-DEIRDLNQKLQLEQEKLSSDYNKLK-IEDQEREMKLEKLLLLNDKR EQAREDLKGLEETVS-RELQTLHNLRKLFVQDLTTRVKKSVELDNDDGGGSA-AQKQKISFLENNLEQLTKV HKQLVRDNADLR-CELPKLEKRLRATAERVKALESALKEAK-ENAMRDRKRYQQEVDRIKEAVRAKNMAR RAHSA-QIAKPIRPGHYPASSPTAVHAIRGGGGSSSNSTHYQK corresponding to amino acids 284-957 of KF5C_HUMAN (SEQ ID NO:1438), which also corresponds to amino acids 1-674 of M62096_PEA__1_P5 (SEQ ID NO:1342).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA__1_P5 (SEQ ID NO:1342) is encoded by the following transcript(s): M62096_PEA__1_T7 (SEQ ID NO:68), for which the sequence(s) is/are given at the end of the application. The coding portion of transcript M62096_PEA__1_T7 (SEQ ID NO:68) is shown in bold; this coding portion starts at position 283 and ends at position 2304. The transcript also has the following SNPs as listed in Table 600 (given according to their position on the nucleotide sequence, with the alternative nucleic acid listed; the last column indicates whether the SNP is known or not; the presence of known SNPs in variant protein M62096_PEA__1_P5 (SEQ ID NO:1342) sequence provides support for the deduced sequence of this variant protein according to the present invention).

TABLE 600

Nucleic acid SNPs

| SNP position on nucleotide sequence | Alternative nucleic acid | Previously known SNP? |
|---|---|---|
| 5779 | G -> T | No |

Variant protein M62096_PEA__1_P3 (SEQ ID NO:1343) according to the present invention has an amino acid sequence as given at the end of the application; it is encoded by transcript(s) M62096_PEA__1_T9 (SEQ ID NO:69). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA__1_P3 (SEQ ID NO:1343) and KF5C_HUMAN (SEQ ID NO:1438):

1. An isolated chimeric polypeptide encoding for M62096_PEA__1_P3 (SEQ ID NO:1343), comprising a first amino acid sequence being at least 90% homologous to MEL-NRWRNGEAVPEDEQISAKDQKN-LEPCDNTPIIDNIAPVVAGISTEEKEKY-DEEISSLYRQLDDKDDEIN QQSQLAEKLKQQMLDQDELLASTR-RDYEKIQEELTRLQIENEAAKDEVKEV-LQALEELAVNYDQKSQEV EDKTRANEQLT-DELAQKTTTLTTTQRELSQLQELSNHQKKRATEILNL-LLKDLGEIGGIIGTNDVKTLADV NGVIEEEFTMARLY-ISKMKSEVKSLVNRSKQLESAQMDSNRK-MNASERELAACQLLISQHEAKIKSLTDY MQN-MEQKRRQLEESQDSLSEELAKLRAQEKMHEVSFQD-KEKEHLTRLQDAEEMKKALEQQMESHREAH QKQLSRLRDEIEEKQKIIDEIRDLNQKLQLEQEKLSS-DYNKLKIEDQEREMKLEKLLLLNDKREQAREDLK GLEETVSRELQTLHNLRKLFVQDLTTRVKKSVEL-DNDDGGGSAAQKQKISFLENNLEQLTKVHKQLVRD NADLRCELPKLEKRLRATAERVKALESALKEAKE-NAMRDRKRYQQEVDRIKEAVRAKNMARRAHSAQI AKPIRPGHYPASSPTAVHAIRGGGGSSSNSTHYQK corresponding to amino acids 365-957 of KF5C_HUMAN (SEQ ID NO:1438), which also corresponds to amino acids 1-593 of M62096_PEA__1_P3 (SEQ ID NO:1343).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA__1_P3 (SEQ ID NO:1343) is encoded by the following transcript(s): M62096_PEA__1_T9 (SEQ ID NO:69), for which the sequence(s) is/are given at the end of the application. The coding portion of transcript M62096_PEA__1_T9 (SEQ ID NO:69) is shown in bold; this coding portion starts at position 565 and ends at position 2343. The transcript also has the following SNPs as listed in Table 601 (given according to their position on the nucleotide sequence, with the alternative nucleic acid listed; the last column indicates whether the SNP is known or not; the presence of known SNPs in variant protein M62096_PEA__1_P3 (SEQ ID NO:1343) sequence provides support for the deduced sequence of this variant protein according to the present invention).

TABLE 601

Nucleic acid SNPs

| SNP position on nucleotide sequence | Alternative nucleic acid | Previously known SNP? |
|---|---|---|
| 5818 | G -> T | No |

Variant protein M62096_PEA__1_P7 (SEQ ID NO:1344) according to the present invention has an amino acid sequence as given at the end of the application; it is encoded by transcript(s) M62096_PEA__1_T11 (SEQ ID NO:70). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P7 (SEQ ID NO:1344) and KF5C_HUMAN (SEQ ID NO:1438):

1. An isolated chimeric polypeptide encoding for M62096_PEA_1_P7 (SEQ ID NO:1344), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO:1727) corresponding to amino acids 1-19 of M62096_PEA_1_P7 (SEQ ID NO:1344), and a second amino acid sequence being at least 90% homologous to LNQKLQLEQEKLSSDYNKLKIEDQEREMKLEKLL-LLNDKREQAREDLKGLEETVSRELQTLHNLRKLFVQ DLTTRVKKSVELDNDDGGGSAAQKQKISFLENNLE-QLTKVHKQLVRDNADLRCELPKLEKRLRATAERV KALESALKEAKENAMRDRKRYQQEVDRIKEAVR-AKNMARRAHSAQIAKPIRPGHYPASSPTAVHAIRGG GGSSSNSTHYQK corresponding to amino acids 738-957 of KF5C_HUMAN (SEQ ID NO:1438), which also corresponds to amino acids 20-239 of M62096_PEA_1_P7 (SEQ ID NO:1344), wherein said first amino acid sequence and second amino acid sequence are contiguous and in a sequential order.

2. An isolated polypeptide encoding for a head of M62096_PEA_1_P7 (SEQ ID NO:1344), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P7 (SEQ ID NO:1344).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Non-secretory protein, NN:YES) predicts that this protein has a signal peptide.

Variant protein M62096_PEA_1_P7 (SEQ ID NO:1344) is encoded by the following transcript(s): M62096_PEA_1_T11 (SEQ ID NO:70), for which the sequence(s) is/are given at the end of the application. The coding portion of transcript M62096_PEA_1_T11 (SEQ ID NO:70) is shown in bold; this coding portion starts at position 633 and ends at position 1349. The transcript also has the following SNPs as listed in Table 602 (given according to their position on the nucleotide sequence, with the alternative nucleic acid listed; the last column indicates whether the SNP is known or not; the presence of known SNPs in variant protein M62096_PEA_1_P7 (SEQ ID NO:1344) sequence provides support for the deduced sequence of this variant protein according to the present invention).

TABLE 602

| Nucleic acid SNPs | | |
|---|---|---|
| SNP position on nucleotide sequence | Alternative nucleic acid | Previously known SNP? |
| 4824 | G -> T | No |

Variant protein M62096_PEA_1_P8 (SEQ ID NO:1345) according to the present invention has an amino acid sequence as given at the end of the application; it is encoded by transcript(s) M62096_PEA_1_T13 (SEQ ID NO:71). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P8 (SEQ ID NO:1345) and KF5C_HUMAN (SEQ ID NO:1438):

1. An isolated chimeric polypeptide encoding for M62096_PEA_1_P8 (SEQ ID NO:1345), comprising a first amino acid sequence being at least 90% homologous to MADPAECSIKVMCRFRPLNEAEILRGDKFIPKFK-GDETVVIGQGKPYVFDRVLPPNTTQEQVYNACA-KQIV KDVLEGYNGTIFAYGQTSSGKTHTMEGKLHD-PQLMGIIPRIAHDIFDHIYSMDENLEFHIKVSYFEIY-LDKIR DLLDVSKTNLAVHEDKNRVPYVKGCTER-FVSSPEEVMDVIDEGKANRHVAVTNMNE-HSSRSHSIFLINIK QENVETEKKLSGKLYLVDLAG-SEKVSKTGAEGAVLDEAKNINKSLSALGNVISALAE-GTKTHVPYRDSKM TRILQDSLGGNCRTTIVICCSPS-VFNEAETKSTLMFGQRAKTIKNTVSVN-LELTAEEWKKKYEKEKEKNKT LKNVIQHLEMELNR-WRNGEAVPEDEQISAKDQKNLEPCDNTPIIDNIAPVV-AGISTEEKEKYDEEISSLYRQ LDDKDDEIN-QQSQLAEKLKQQMLDQDELLASTR-RDYEKIQEELTRLQIENEAAKDEVKEVLQALEELAVN YDQKSQEVEDKTRANEQLTDELAQKTT-TLTTQRELSQLQELSNHQKKRATEILN-LLLKDLGEIGGIIGTN DVKTLADVNGVIEEEFTMAR-LYISKMKSEVKSLVNRSKQLESAQMDSNRKMNASE-RELAACQLLISQHEA KIKSLTDYMQN-MEQKRRQLEESQDSLSEELAKLRAQEKM-HEVSFQDKEKEHLTRLQDAEEMKKALEQQ MESHREAHQKQLSRLRDEIEEKQKIIDEIR corresponding to amino acids 1-736 of KF5C_HUMAN (SEQ ID NO:1438), which also corresponds to amino acids 1-736 of M62096_PEA_1_P8 (SEQ ID NO:1345), and a second amino acid sequence being at least 70%, optionally at least 80%, preferably at least 85%, more preferably at least 90% and most preferably at least 95% homologous to a polypeptide having the sequence E corresponding to amino acids 737-737 of M62096_PEA_1_P8 (SEQ ID NO:1345), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P8 (SEQ ID NO:1345) also has the following non-silent SNPs (Single Nucleotide Polymorphisms) as listed in Table 603, (given according to their position(s) on the amino acid sequence, with the alternative amino acid(s) listed; the last column indicates whether the SNP is known or not; the presence of known SNPs in variant protein M62096_PEA_1_P8 (SEQ ID NO:1345) sequence provides support for the deduced sequence of this variant protein according to the present invention).

TABLE 603

Amino acid mutations

| SNP position(s) on nucleotide sequence | Alternative nucleic acid | Previously known SNP? |
|---|---|---|
| 5 | A -> T | Yes |

Variant protein M62096_PEA_1_P8 (SEQ ID NO:1345) is encoded by the following transcript(s): M62096_PEA_1_T13 (SEQ ID NO:71), for which the sequence(s) is/are given at the end of the application. The coding portion of transcript M62096_PEA_1_T13 (SEQ ID NO:71) is shown in bold; this coding portion starts at position 396 and ends at position 2606. The transcript also has the following SNPs as listed in Table 604 (given according to their position on the nucleotide sequence, with the alternative nucleic acid listed; the last column indicates whether the SNP is known or not; the presence of known SNPs in variant protein M62096_PEA_1_P8 (SEQ ID NO:1345) sequence provides support for the deduced sequence of this variant protein according to the present invention).

TABLE 604

Nucleic acid SNPs

| SNP position on nucleotide sequence | Alternative nucleic acid | Previously known SNP? |
|---|---|---|
| 92 | C -> A | Yes |
| 408 | G -> A | Yes |

Variant protein M62096_PEA_1_P9 (SEQ ID NO:1346) according to the present invention has an amino acid sequence as given at the end of the application; it is encoded by transcript(s) M62096_PEA_1_T14 (SEQ ID NO:72). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P9 (SEQ ID NO:1346) and KF5C_HUMAN (SEQ ID NO:1438):

1. An isolated chimeric polypeptide encoding for M62096_PEA_1_P9 (SEQ ID NO:1346), comprising a first amino acid sequence being at least 90% homologous to MADPAECSIKVMCRFRPLNEAEILRGDK-FIPKFKGDETVVIGQGKPYVFDRVLPPN-TrQEQVYNACAKQIV KDVLEGYNGTIFAYGQTSSGK-THTMEGKLHDPQLMGIIPRIAHDIFDHIYSMDENLEF-HIKVSYFEIYLDKIR DLLDVSKTNLAVHEDKN-RVPYVKGCTERFVSSPEEVMDVIDEGKANRHVAVT-NMNEHSSRSHSIFLINIK QENVETEKKLSGKLYLVD-LAGSEKVSKTGAEGAVLDEAKNINKSLSALGNVIS-ALAEGTKTHVPYRDSKM TRILQDSLGGNCRTTIV-ICCSPSVFNEAETKSTLMFGQRAKTIKNTVSVNLE-LTAEEWKKKYEKEKEKNKT LKNVIQHLEMELNR-WRNGEAVPEDEQISAKDQKNLEPCDNT-PIIDNIAPVVAGISTEEKEKYDEEISSLYRQ LDDKD-DEINQQSQLAEKLKQQMLDQE corresponding to amino acids 1-454 of KF5C_HUMAN (SEQ ID NO:1438), which also corresponds to amino acids 1-454 of M62096_PEA_1_P9 (SEQ ID NO:1346), and a second amino acid sequence being at least 70%, optionally at least 80%, preferably at least 85%, more preferably at least 90% and most preferably at least 95% homologous to a polypeptide having the sequence VKNAIYFFFHKVLLLLFVVD-VCSRNLIGIEAFHNYRIMWK-FLGRCPFTASYKLIITEFRK (SEQ ID NO:1728) corresponding to amino acids 455-514 of M62096_PEA_1_P9 (SEQ ID NO:1346), wherein said first amino acid sequence and second amino acid sequence are contiguous and in a sequential order.

2. An isolated polypeptide encoding for a tail of M62096_PEA_1_P9 (SEQ ID NO:1346), comprising a polypeptide being at least 70%, optionally at least about 80%, preferably at least 85%, more preferably at least about 90% and most preferably at least about 95% homologous to the sequence VKNAIYFFFHKVLLLLFVVDVCSRN-LIGIEAFHNYRIMWKFLGRCPFTASYKLIITEFRK (SEQ ID NO:1728) in M62096_PEA_1_P9 (SEQ ID NO:1346).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P9 (SEQ ID NO:1346) also has the following non-silent SNPs (Single Nucleotide Polymorphisms) as listed in Table 605, (given according to their position(s) on the amino acid sequence, with the alternative amino acid(s) listed; the last column indicates whether the SNP is known or not; the presence of known SNPs in variant protein M62096_PEA_1_P9 (SEQ ID NO:1346) sequence provides support for the deduced sequence of this variant protein according to the present invention).

TABLE 605

Amino acid mutations

| SNP position(s) on nucleotide sequence | Alternative nucleic acid | Previously known SNP? |
|---|---|---|
| 5 | A -> T | Yes |

Variant protein M62096_PEA_1_P9 (SEQ ID NO:1346) is encoded by the following transcript(s): M62096_PEA_1_T14 (SEQ ID NO:72), for which the sequence(s) is/are given at the end of the application. The coding portion of transcript M62096_PEA_1_T14 (SEQ ID NO:72) is shown in bold; this coding portion starts at position 396 and ends at position 1937. The transcript also has the following SNPs as listed in Table 606 (given according to their position on the nucleotide sequence, with the alternative nucleic acid listed; the last column indicates whether the SNP is known or not; the presence of known SNPs in variant protein M62096_PEA_1_P9 (SEQ ID NO:1346) sequence provides support for the deduced sequence of this variant protein according to the present invention).

TABLE 606

Nucleic acid SNPs

| SNP position on nucleotide sequence | Alternative nucleic acid | Previously known SNP? |
|---|---|---|
| 92 | C -> A | Yes |
| 408 | G -> A | Yes |

Variant protein M62096_PEA_1_P10 (SEQ ID NO:1347) according to the present invention has an amino acid sequence as given at the end of the application; it is encoded by transcript(s) M62096_PEA_1_T15 (SEQ ID NO:73). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P10 (SEQ ID NO:1347) and KF5C_HUMAN (SEQ ID NO:1438):

1. An isolated chimeric polypeptide encoding for M62096_PEA_1_P10 (SEQ ID NO:1347), comprising a first amino acid sequence being at least 70%, optionally at least 80%, preferably at least 85%, more preferably at least 90% and most preferably at least 95% homologous to a polypeptide having the sequence MTQNFRLMWNILLFPLNFS (SEQ ID NO:1727) corresponding to amino acids 1-19 of M62096_PEA_1_P10 (SEQ ID NO:1347), a second amino acid sequence being at least 90% homologous to LNQKLQLEQEKLSSDYNKLKIEDQEREMKLEKLLLLNDKREQAREDLKGLEETVSRELQTLHNLRKLFVQ DLTTRVKK corresponding to amino acids 738-815 of KF5C_HUMAN (SEQ ID NO:1438), which also corresponds to amino acids 20-97 of M62096_PEA_1_P10 (SEQ ID NO:1347), and a third amino acid sequence being at least 70%, optionally at least 80%, preferably at least 85%, more preferably at least 90% and most preferably at least 95% homologous to a polypeptide having the sequence VSSLCLNGTEKKIKDGREESFSVEISLA (SEQ ID NO:1730) corresponding to amino acids 98-125 of M62096_PEA_1_P10 (SEQ ID NO:1347), wherein said first amino acid sequence, second amino acid sequence and third amino acid sequence are contiguous and in a sequential order.

2. An isolated polypeptide encoding for a head of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence MTQNFRLMWNILLFPLNFS (SEQ ID NO:1727) of M62096_PEA_1_P10 (SEQ ID NO:1347).

3. An isolated polypeptide encoding for a tail of M62096_PEA_1_P10 (SEQ ID NO:1347), comprising a polypeptide being at least 70%, optionally at least about 80%, preferably at least about 85%, more preferably at least about 90% and most preferably at least about 95% homologous to the sequence VSSLCLNGTEKKIKDGREESFSVEISLA (SEQ ID NO: 1730) in M62096_PEA_1_P10 (SEQ ID NO:1347).

The location of the variant protein was determined according to results from a number of different software programs and analyses, including analyses from SignalP and other specialized programs. The variant protein is believed to be located as follows with regard to the cell: secreted. The protein localization is believed to be secreted because one of the two signal-peptide prediction programs (HMM:Non-secretory protein, NN:YES) predicts that this protein has a signal peptide.

Variant protein M62096_PEA_1_P10 (SEQ ID NO:1347) is encoded by the following transcript(s): M62096_PEA_1_T15 (SEQ ID NO:73), for which the sequence(s) is/are given at the end of the application. The coding portion of transcript M62096_PEA_1_T15 (SEQ ID NO:73) is shown in bold; this coding portion starts at position 633 and ends at position 1007.

Variant protein M62096_PEA_1_P11 (SEQ ID NO:1348) according to the present invention has an amino acid sequence as given at the end of the application; it is encoded by transcript(s) M62096_PEA_1_T4 (SEQ ID NO:65). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P11 (SEQ ID NO:1348) and KF5C_HUMAN (SEQ ID NO:1438):

1. An isolated chimeric polypeptide encoding for M62096_PEA_1_P11 (SEQ ID NO:1348), comprising a first amino acid sequence being at least 90% homologous to MADPAECSIKVMCRFRPLNEAEILRGDKFIPKFKGDETVVIGQGKPYVFDRVLPPNTTQEQVYNACAKQIV KDVLEGYNGTIFAYGQTSSGKTHTMEGKLHDPQLMGIIPRIAHDIFDHIYSMDENLEFHIKVSYFEIYLDKIR DLLDVSKTNLAVHEDKNRVPYVKGCTERFVSSPEEVMDVIDEGKANRHVAVTNMNEHSSRSHSIFLINIK QENVETEKKLSGKLYLVDLAGSEKVSKTGAEGAVLDEAKNINKSLSALGNVISALAEGTKTHVPYRDSKM TRILQDSLGGNCRTTIVICCSPSVFNEAETKSTLMFGQRAKTIKNTVSVNLELTAEEWKKKYEKEKEKNKT LKNVIQHLEMELNRWRN corresponding to amino acids 1-372 of KF5C_HUMAN (SEQ ID NO:1438), which also corresponds to amino acids 1-372 of M62096_PEA_1_P11 (SEQ ID NO:1348), and a second amino acid sequence being at least 70%, optionally at least 80%, preferably at least 85%, more preferably at least 90% and most preferably at least 95% homologous to a polypeptide having the sequence DFLAAHVFGKLLE (SEQ ID NO: 1731) corresponding to amino acids 373-385 of M62096_PEA_1_P11 (SEQ ID NO:1348), wherein said first amino acid sequence and second amino acid sequence are contiguous and in a sequential order.

2. An isolated polypeptide encoding for a tail of M62096_PEA_1_P11 (SEQ ID NO:1348), comprising a polypeptide being at least 70%, optionally at least about 80%, preferably at least about 85%, more preferably at least about 90% and most preferably at least about 95% homologous to the sequence DFLAAHVFGKLLE (SEQ ID NO:1731) in M62096_PEA_1_P11 (SEQ ID NO:1348).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P11 (SEQ ID NO:1348) also has the following non-silent SNPs (Single Nucleotide Polymorphisms) as listed in Table 607, (given according to their position(s) on the amino acid sequence, with the alternative amino acid(s) listed; the last column indicates whether the SNP is known or not; the presence of known SNPs in variant protein M62096_PEA_1_P11 (SEQ ID NO:1348) sequence provides support for the deduced sequence of this variant protein according to the present invention).

TABLE 607

Amino acid mutations

| SNP position(s) on nucleotide sequence | Alternative nucleic acid | Previously known SNP? |
|---|---|---|
| 5 | A -> T | Yes |

Variant protein M62096_PEA_1_P11 (SEQ ID NO:1348) is encoded by the following transcript(s): M62096_PEA_1_T4 (SEQ ID NO:65), for which the sequence(s) is/are given at the end of the application. The coding portion of transcript M62096_PEA_1_T4 (SEQ ID NO:65) is shown in bold; this coding portion starts at position 396 and ends at position 1550. The transcript also has the following SNPs as listed in Table 608 (given according to their position on the nucleotide sequence, with the alternative nucleic acid listed; the last column indicates whether the SNP is known or not; the presence of known SNPs in variant protein M62096_PEA_1_P11 (SEQ ID NO:1348) sequence provides support for the deduced sequence of this variant protein according to the present invention).

TABLE 608

Nucleic acid SNPs

| SNP position on nucleotide sequence | Alternative nucleic acid | Previously known SNP? |
|---|---|---|
| 92 | C -> A | Yes |
| 408 | G -> A | Yes |
| 6908 | G -> T | No |

Variant protein M62096_PEA_1_P12 (SEQ ID NO:1349) according to the present invention has an amino acid sequence as given at the end of the application; it is encoded by transcript(s) M62096_PEA_1_T5 (SEQ ID NO:66). An alignment is given to the known protein (Kinesin heavy chain isoform 5C (SEQ ID NO:1438)) at the end of the application. One or more alignments to one or more previously published protein sequences are given at the end of the application. A brief description of the relationship of the variant protein according to the present invention to each such aligned protein is as follows:

Comparison report between M62096_PEA_1_P12 (SEQ ID NO:1349) and KF5C_HUMAN (SEQ ID NO:1438):

1. An isolated chimeric polypeptide encoding for M62096_PEA_1_P12 (SEQ ID NO:1349), comprising a first amino acid sequence being at least 90% homologous to MADPAECSIKVMCRFRPLNEAEILRGDKFIPKFK-GDETVVIGQGKPYVFDRVLPPNTTQEQVYNACA-KQIV KDVLEGYNGTIFAYGQTSSGKTHTMEGKLH-DPQLMGIIPRIAHDIFDHIYSMDENLEFHIKVSYF-EIYLDKIR DLLDVSKTNLAVHEDKNRVPYVKGCTER-FVSSPEEVMDVIDEGKANRHVAVTNMNEHSSRS-HSIFLINIK QENVETEKKLSGKLYLVDLAGSEKVSKT-GAEGAVLDEAKNINKSLSALGNVIS-ALAEGTKTHVPYRDSKM TRILQDSLGGNCRTTIV-ICCSPSVFNEAETKSTLMFGQR corresponding to amino acids 1-323 of KF5C_HUMAN (SEQ ID NO:1438), which also corresponds to amino acids 1-323 of M62096_PEA_1_P12 (SEQ ID NO:1349), and a second amino acid sequence being at least 70%, optionally at least 80%, preferably at least 85%, more preferably at least 90% and most preferably at least 95% homologous to a polypeptide having the sequence V corresponding to amino acids 324-324 of M62096_PEA_1_P12 (SEQ ID NO:1349), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein M62096_PEA_1_P12 (SEQ ID NO:1349) also has the following non-silent SNPs (Single Nucleotide Polymorphisms) as listed in Table 609, (given according to their position(s) on the amino acid sequence, with the alternative amino acid(s) listed; the last column indicates whether the SNP is known or not; the presence of known SNPs in variant protein M62096_PEA_1_P12 (SEQ ID NO:1349) sequence provides support for the deduced sequence of this variant protein according to the present invention).

TABLE 609

Amino acid mutations

| SNP position(s) on amino acid sequence | Alternative amino acid(s) | Previously known SNP? |
|---|---|---|
| 5 | A -> T | Yes |

Variant protein M62096_PEA_1_P12 (SEQ ID NO:1349) is encoded by the following transcript(s): M62096_PEA_1_T5 (SEQ ID NO:66), for which the sequence(s) is/are given at the end of the application. The coding portion of transcript M62096_PEA_1_T5 (SEQ ID NO:66) is shown in bold; this coding portion starts at position 378 and ends at position 1349. The transcript also has the following SNPs as listed in Table 610 (given according to their position on the nucleotide sequence, with the alternative nucleic acid listed; the last column indicates whether the SNP is known or not; the presence of known SNPs in variant protein M62096_PEA_1_P12 (SEQ ID NO:1349) sequence provides support for the deduced sequence of this variant protein according to the present invention).

TABLE 610

Nucleic acid SNPs

| SNP position on nucleotide sequence | Alternative nucleotide acid | Previously known SNP? |
|---|---|---|
| 92 | C -> A | Yes |
| 390 | G -> A | Yes |
| 6784 | G -> T | No |

As noted above, cluster M62096 features 42 segment(s), which were listed in Table 596 above and for which the sequence(s) are given at the end of the application. These segment(s) are portions of nucleic acid sequence(s) which are described herein separately because they are of particular interest. A description of each segment according to the present invention is now provided.

Segment cluster M62096_PEA_1_node_0 (SEQ ID NO:616) according to the present invention is supported by 14 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 611 below describes the starting and ending position of this segment on each transcript.

TABLE 611

Segment location on transcripts

| Transcript name | Segment starting position | Segment ending position |
|---|---|---|
| M62096_PEA_1_T4 (SEQ ID NO:65) | 1 | 355 |
| M62096_PEA_1_T5 (SEQ ID NO:66) | 1 | 355 |
| M62096_PEA_1_T13 (SEQ ID NO:71) | 1 | 355 |
| M62096_PEA_1_T14 (SEQ ID NO:72) | 1 | 355 |

Segment cluster M62096_PEA_1_node_2 (SEQ ID NO:617) according to the present invention is supported by 12 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 612 below describes the starting and ending position of this segment on each transcript.

TABLE 612

Segment location on transcripts

| Transcript name | Segment starting position | Segment ending position |
|---|---|---|
| M62096_PEA_1_T4 (SEQ ID NO:65) | 374 | 521 |
| M62096_PEA_1_T5 (SEQ ID NO:66) | 356 | 503 |
| M62096_PEA_1_T13 (SEQ ID NO:71) | 374 | 521 |
| M62096_PEA_1_T14 (SEQ ID NO:72) | 374 | 521 |

Segment cluster M62096_PEA_1_node_15 (SEQ ID NO:618) according to the present invention is supported by 28 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 613 below describes the starting and ending position of this segment on each transcript.

TABLE 613

Segment location on transcripts

| Transcript name | Segment starting position | Segment ending position |
|---|---|---|
| M62096_PEA_1_T4 (SEQ ID NO:65) | 985 | 1109 |
| M62096_PEA_1_T5 (SEQ ID NO:66) | 967 | 1091 |
| M62096_PEA_1_T13 (SEQ ID NO:71) | 985 | 1109 |
| M62096_PEA_1_T14 (SEQ ID NO:72) | 985 | 1109 |

Segment cluster M62096_PEA_1_node_17 (SEQ ID NO:619) according to the present invention is supported by 1 libraries. The number of libraries was determined as previously described. This segment can be found in the following transcript(s): M62096_PEA_1_T7 (SEQ ID NO:68). Table 614 below describes the starting and ending position of this segment on each transcript.

TABLE 614

Segment location on transcripts

| Transcript name | Segment starting position | Segment ending position |
|---|---|---|
| M62096_PEA_1_T7 (SEQ ID NO:68) | 1 | 147 |

Segment cluster M62096_PEA_1_node_19 (SEQ ID NO:620) according to the present invention is supported by 3 libraries. The number of libraries was determined as previously described. This segment can be found in the following transcript(s): M62096_PEA_1_T6 (SEQ ID NO:67) and M62096_PEA_1_T9 (SEQ ID NO:69). Table 615 below describes the starting and ending position of this segment on each transcript.

TABLE 615

Segment location on transcripts

| Transcript name | Segment starting position | Segment ending position |
|---|---|---|
| M62096_PEA_1_T6 (SEQ ID NO:67) | 1 | 125 |
| M62096_PEA_1_T9 (SEQ ID NO:69) | 1 | 125 |

Segment cluster M62096_PEA_1_node_23 (SEQ ID NO:621) according to the present invention is supported by 36 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 616 below describes the starting and ending position of this segment on each transcript.

TABLE 616

Segment location on transcripts

| Transcript name | Segment starting position | Segment ending position |
|---|---|---|
| M62096_PEA_1_T4 (SEQ ID NO:65) | 1215 | 1363 |
| M62096_PEA_1_T5 (SEQ ID NO:66) | 1197 | 1345 |
| M62096_PEA_1_T6 (SEQ ID NO:67) | 231 | 379 |
| M62096_PEA_1_T7 (SEQ ID NO:68) | 253 | 401 |
| M62096_PEA_1_T9 (SEQ ID NO:69) | 231 | 379 |
| M62096_PEA_1_T13 (SEQ ID NO:71) | 1215 | 1363 |
| M62096_PEA_1_T14 (SEQ ID NO:72) | 1215 | 1363 |

Segment cluster M62096_PEA_1_node_27 (SEQ ID NO:623) according to the present invention is supported by 35 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 617 below describes the starting and ending position of this segment on each transcript.

TABLE 617

Segment location on transcripts

| Transcript name | Segment starting position | Segment ending position |
|---|---|---|
| M62096_PEA_1_T4 (SEQ ID NO:65) | 1364 | 1512 |
| M62096_PEA_1_T5 (SEQ ID NO:66) | 1407 | 1555 |
| M62096_PEA_1_T6 (SEQ ID NO:67) | 380 | 528 |
| M62096_PEA_1_T7 (SEQ ID NO:68) | 402 | 550 |
| M62096_PEA_1_T9 (SEQ ID NO:69) | 441 | 589 |
| M62096_PEA_1_T13 (SEQ ID NO:71) | 1364 | 1512 |
| M62096_PEA_1_T14 (SEQ ID NO:72) | 1364 | 1512 |

Segment cluster M62096_PEA_1_node_29 (SEQ ID NO:624) according to the present invention is supported by 1 libraries. The number of libraries was determined as previously described. This segment can be found in the following transcript(s): M62096_PEA_1_T4 (SEQ ID NO:65). Table 618 below describes the starting and ending position of this segment on each transcript.

TABLE 618

Segment location on transcripts

| Transcript name | Segment starting position | Segment ending position |
|---|---|---|
| M62096_PEA_1_T4 (SEQ ID NO:65) | 1513 | 1679 |

Segment cluster M62096_PEA_1_node_31 (SEQ ID NO:625) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 619 below describes the starting and ending position of this segment on each transcript.

TABLE 619

Segment location on transcripts

| Transcript name | Segment starting position | Segment ending position |
|---|---|---|
| M62096_PEA_1_T4 (SEQ ID NO:65) | 1680 | 1855 |
| M62096_PEA_1_T5 (SEQ ID NO:66) | 1556 | 1731 |
| M62096_PEA_1_T6 (SEQ ID NO:67) | 529 | 704 |
| M62096_PEA_1_T7 (SEQ ID NO:68) | 551 | 726 |
| M62096_PEA_1_T9 (SEQ ID NO:69) | 590 | 765 |
| M62096_PEA_1_T13 (SEQ ID NO:71) | 1513 | 1688 |
| M62096_PEA_1_T14 (SEQ ID NO:72) | 1513 | 1688 |

Segment cluster M62096_PEA_1_node_34 (SEQ ID NO:626) according to the present invention is supported by 3 libraries. The number of libraries was determined as previously described. This segment can be found in the following transcript(s): M62096_PEA_1_T14 (SEQ ID NO:72). Table 620 below describes the starting and ending position of this segment on each transcript.

TABLE 620

Segment location on transcripts

| Transcript name | Segment starting position | Segment ending position |
|---|---|---|
| M62096_PEA_1_T14 (SEQ ID NO:72) | 1758 | 2261 |

Segment cluster M62096_PEA_1_node_36 (SEQ ID NO:627) according to the present invention is supported by 26 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 621 below describes the starting and ending position of this segment on each transcript.

TABLE 621

Segment location on transcripts

| Transcript name | Segment starting position | Segment ending position |
|---|---|---|
| M62096_PEA_1_T4 (SEQ ID NO:65) | 1925 | 2131 |
| M62096_PEA_1_T5 (SEQ ID NO:66) | 1801 | 2007 |
| M62096_PEA_1_T6 (SEQ ID NO:67) | 774 | 980 |
| M62096_PEA_1_T7 (SEQ ID NO:68) | 796 | 1002 |
| M62096_PEA_1_T9 (SEQ ID NO:69) | 835 | 1041 |
| M62096_PEA_1_T13 (SEQ ID NO:71) | 1758 | 1964 |

Segment cluster M62096_PEA_1_node_38 (SEQ ID NO:628) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 622 below describes the starting and ending position of this segment on each transcript.

TABLE 622

Segment location on transcripts

| Transcript name | Segment starting position | Segment ending position |
| --- | --- | --- |
| M62096_PEA_1_T4 (SEQ ID NO:65) | 2132 | 2278 |
| M62096_PEA_1_T5 (SEQ ID NO:66) | 2008 | 2154 |
| M62096_PEA_1_T6 (SEQ ID NO:67) | 981 | 1127 |
| M62096_PEA_1_T7 (SEQ ID NO:68) | 1003 | 1149 |
| M62096_PEA_1_T9 (SEQ ID NO:69) | 1042 | 1188 |
| M62096_PEA_1_T13 (SEQ ID NO:71) | 1965 | 2111 |

Segment cluster M62096_PEA_1_node_40 (SEQ ID NO:629) according to the present invention is supported by 21 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 623 below describes the starting and ending position of this segment on each transcript.

TABLE 623

Segment location on transcripts

| Transcript name | Segment starting position | Segment ending position |
| --- | --- | --- |
| M62096_PEA_1_T4 (SEQ ID NO:65) | 2279 | 2467 |
| M62096_PEA_1_T5 (SEQ ID NO:66) | 2155 | 2343 |
| M62096_PEA_1_T6 (SEQ ID NO:67) | 1128 | 1316 |
| M62096_PEA_1_T7 (SEQ ID NO:68) | 1150 | 1338 |
| M62096_PEA_1_T9 (SEQ ID NO:69) | 1189 | 1377 |
| M62096_PEA_1_T13 (SEQ ID NO:71) | 2112 | 2300 |

Segment cluster M62096_PEA_1_node_48 (SEQ ID NO:630) according to the present invention is supported by 7 libraries. The number of libraries was determined as previously described. This segment can be found in the following transcript(s): M62096_PEA_1_T13 (SEQ ID NO:71). Table 624 below describes the starting and ending position of this segment on each transcript.

TABLE 624

Segment location on transcripts

| Transcript name | Segment starting position | Segment ending position |
| --- | --- | --- |
| M62096_PEA_1_T13 (SEQ ID NO:71) | 2606 | 2945 |

Segment cluster M62096_PEA_1_node_50 (SEQ ID NO:631) according to the present invention is supported by 3 libraries. The number of libraries was determined as previously described. This segment can be found in the following transcript(s): M62096_PEA_1_T11 (SEQ ID NO:70) and M62096_PEA_1_T15 (SEQ ID NO:73). Table 625 below describes the starting and ending position of this segment on each transcript.

TABLE 625

Segment location on transcripts

| Transcript name | Segment starting position | Segment ending position |
| --- | --- | --- |
| M62096_PEA_1_T11 (SEQ ID NO:70) | 1 | 688 |
| M62096_PEA_1_T15 (SEQ ID NO:73) | 1 | 688 |

Segment cluster M62096_PEA_1_node_56 (SEQ ID NO:632) according to the present invention is supported by 1 libraries. The number of libraries was determined as previously described. This segment can be found in the following transcript(s): M62096_PEA_1_T15 (SEQ ID NO:73). Table 626 below describes the starting and ending position of this segment on each transcript.

TABLE 626

Segment location on transcripts

| Transcript name | Segment starting position | Segment ending position |
| --- | --- | --- |
| M62096_PEA_1_T15 (SEQ ID NO:73) | 924 | 1059 |

Segment cluster M62096_PEA_1_node_60 (SEQ ID NO:633) according to the present invention is supported by 13 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 627 below describes the starting and ending position of this segment on each transcript.

TABLE 627

Segment location on transcripts

| Transcript name | Segment starting position | Segment ending position |
| --- | --- | --- |
| M62096_PEA_1_T4 (SEQ ID NO:65) | 3113 | 3329 |
| M62096_PEA_1_T5 (SEQ ID NO:66) | 2989 | 3205 |
| M62096_PEA_1_T6 (SEQ ID NO:67) | 1962 | 2178 |
| M62096_PEA_1_T7 (SEQ ID NO:68) | 1984 | 2200 |
| M62096_PEA_1_T9 (SEQ ID NO:69) | 2023 | 2239 |
| M62096_PEA_1_T11 (SEQ ID NO:70) | 1029 | 1245 |

Segment cluster M62096_PEA_1_node_65 (SEQ ID NO:634) according to the present invention is supported by 51 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 628 below describes the starting and ending position of this segment on each transcript.

TABLE 628

Segment location on transcripts

| Transcript name | Segment starting position | Segment ending position |
|---|---|---|
| M62096_PEA_1_T4 (SEQ ID NO:65) | 3444 | 4763 |
| M62096_PEA_1_T5 (SEQ ID NO:66) | 3320 | 4639 |
| M62096_PEA_1_T6 (SEQ ID NO:67) | 2293 | 3612 |
| M62096_PEA_1_T7 (SEQ ID NO:68) | 2315 | 3634 |
| M62096_PEA_1_T9 (SEQ ID NO:69) | 2354 | 3673 |
| M62096_PEA_1_T11 (SEQ ID NO:70) | 1360 | 2679 |

Segment cluster M62096_PEA_1_node_69 (SEQ ID NO:635) according to the present invention is supported by 85 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 629 below describes the starting and ending position of this segment on each transcript.

TABLE 629

Segment location on transcripts

| Transcript name | Segment starting position | Segment ending position |
|---|---|---|
| M62096_PEA_1_T4 (SEQ ID NO:65) | 4894 | 5826 |
| M62096_PEA_1_T5 (SEQ ID NO:66) | 4770 | 5702 |
| M62096_PEA_1_T6 (SEQ ID NO:67) | 3743 | 4675 |
| M62096_PEA_1_T7 (SEQ ID NO:68) | 3765 | 4697 |
| M62096_PEA_1_T9 (SEQ ID NO:69) | 3804 | 4736 |
| M62096_PEA_1_T11 (SEQ ID NO:70) | 2810 | 3742 |

Segment cluster M62096_PEA_1_node_71 (SEQ ID NO:636) according to the present invention is supported by 178 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 630 below describes the starting and ending position of this segment on each transcript.

TABLE 630

Segment location on transcripts

| Transcript name | Segment starting position | Segment ending position |
|---|---|---|
| M62096_PEA_1_T4 (SEQ ID NO:65) | 5882 | 7128 |
| M62096_PEA_1_T5 (SEQ ID NO:66) | 5758 | 7004 |
| M62096_PEA_1_T6 (SEQ ID NO:67) | 4731 | 5977 |
| M62096_PEA_1_T7 (SEQ ID NO:68) | 4753 | 5999 |
| M62096_PEA_1_T9 (SEQ ID NO:69) | 4792 | 6038 |
| M62096_PEA_1_T11 (SEQ ID NO:70) | 3798 | 5044 |

According to an optional embodiment of the present invention, short segments related to the above cluster are also provided. These segments are up to about 120 bp in length, and so are included in a separate description.

Segment cluster M62096_PEA_1_node_1 (SEQ ID NO:637) according to the present invention can be found in the following transcript(s): M62096_PEA_1_T4 (SEQ ID NO:65), M62096_PEA_1_T13 (SEQ ID NO:71) and M62096_PEA_1_T14 (SEQ ID NO:72). Table 631 below describes the starting and ending position of this segment on each transcript.

TABLE 631

Segment location on transcripts

| Transcript name | Segment starting position | Segment ending position |
|---|---|---|
| M62096_PEA_1_T4 (SEQ ID NO:65) | 356 | 373 |
| M62096_PEA_1_T13 (SEQ ID NO:71) | 356 | 373 |
| M62096_PEA_1_T14 (SEQ ID NO:72) | 356 | 373 |

Segment cluster M62096_PEA_1_node_4 (SEQ ID NO:638) according to the present invention is supported by 12 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 632 below describes the starting and ending position of this segment on each transcript.

TABLE 632

Segment location on transcripts

| Transcript name | Segment starting position | Segment ending position |
|---|---|---|
| M62096_PEA_1_T4 (SEQ ID NO:65) | 522 | 612 |
| M62096_PEA_1_T5 (SEQ ID NO:66) | 504 | 594 |
| M62096_PEA_1_T13 (SEQ ID NO:71) | 522 | 612 |
| M62096_PEA_1_T14 (SEQ ID NO:72) | 522 | 612 |

Segment cluster M62096_PEA_1_node_6 (SEQ ID NO:639) according to the present invention is supported by 13 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 633 below describes the starting and ending position of this segment on each transcript.

TABLE 633

Segment location on transcripts

| Transcript name | Segment starting position | Segment ending position |
|---|---|---|
| M62096_PEA_1_T4 (SEQ ID NO:65) | 613 | 686 |
| M62096_PEA_1_T5 (SEQ ID NO:66) | 595 | 668 |
| M62096_PEA_1_T13 (SEQ ID NO:71) | 613 | 686 |
| M62096_PEA_1_T14 (SEQ ID NO:72) | 613 | 686 |

Segment cluster M62096_PEA_1_node_7 (SEQ ID NO:640) according to the present invention is supported by 19 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 634 below describes the starting and ending position of this segment on each transcript.

TABLE 634

Segment location on transcripts

| Transcript name | Segment starting position | Segment ending position |
|---|---|---|
| M62096_PEA_1_T4 (SEQ ID NO:65) | 687 | 791 |
| M62096_PEA_1_T5 (SEQ ID NO:66) | 669 | 773 |
| M62096_PEA_1_T13 (SEQ ID NO:71) | 687 | 791 |
| M62096_PEA_1_T14 (SEQ ID NO:72) | 687 | 791 |

Segment cluster M62096_PEA_1_node_9 (SEQ ID NO:641) according to the present invention is supported by 18 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 635 below describes the starting and ending position of this segment on each transcript.

TABLE 635

Segment location on transcripts

| Transcript name | Segment starting position | Segment ending position |
|---|---|---|
| M62096_PEA_1_T4 (SEQ ID NO:65) | 792 | 840 |
| M62096_PEA_1_T5 (SEQ ID NO:66) | 774 | 822 |
| M62096_PEA_1_T13 (SEQ ID NO:71) | 792 | 840 |
| M62096_PEA_1_T14 (SEQ ID NO:72) | 792 | 840 |

Segment cluster M62096_PEA_1_node_11 (SEQ ID NO:642) according to the present invention is supported by 22 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 636 below describes the starting and ending position of this segment on each transcript.

TABLE 636

Segment location on transcripts

| Transcript name | Segment starting position | Segment ending position |
|---|---|---|
| M62096_PEA_1_T4 (SEQ ID NO:65) | 841 | 896 |
| M62096_PEA_1_T5 (SEQ ID NO:66) | 823 | 878 |
| M62096_PEA_1_T13 (SEQ ID NO:71) | 841 | 896 |
| M62096_PEA_1_T14 (SEQ ID NO:72) | 841 | 896 |

Segment cluster M62096_PEA_1_node_13 (SEQ ID NO:643) according to the present invention is supported by 24 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T13 (SEQ ID NO:71) and M62096_PEA_1_T14 (SEQ ID NO:72). Table 637 below describes the starting and ending position of this segment on each transcript.

TABLE 637

Segment location on transcripts

| Transcript name | Segment starting position | Segment ending position |
|---|---|---|
| M62096_PEA_1_T4 (SEQ ID NO:65) | 897 | 984 |
| M62096_PEA_1_T5 (SEQ ID NO:66) | 879 | 966 |
| M62096_PEA_1_T13 (SEQ ID NO:71) | 897 | 984 |
| M62096_PEA_1_T14 (SEQ ID NO:72) | 897 | 984 |

Segment cluster M62096_PEA_1_node_21 (SEQ ID NO:644) according to the present invention is supported by 33 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_

1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 638 below describes the starting and ending position of this segment on each transcript.

TABLE 638

Segment location on transcripts

| Transcript name | Segment starting position | Segment ending position |
|---|---|---|
| M62096_PEA_1_T4 (SEQ ID NO:65) | 1110 | 1214 |
| M62096_PEA_1_T5 (SEQ ID NO:66) | 1092 | 1196 |
| M62096_PEA_1_T6 (SEQ ID NO:67) | 126 | 230 |
| M62096_PEA_1_T7 (SEQ ID NO:68) | 148 | 252 |
| M62096_PEA_1_T9 (SEQ ID NO:69) | 126 | 230 |
| M62096_PEA_1_T13 (SEQ ID NO:71) | 1110 | 1214 |
| M62096_PEA_1_T14 (SEQ ID NO:72) | 1110 | 1214 |

Segment cluster M62096_PEA_1_node_25 (SEQ ID NO:645) according to the present invention is supported by 3 libraries. The number of libraries was determined as previously described. This segment can be found in the following transcript(s): M62096_PEA_1_T5 (SEQ ID NO:66) and M62096_PEA_1_T9 (SEQ ID NO:69). Table 639 below describes the starting and ending position of this segment on each transcript.

TABLE 639

Segment location on transcripts

| Transcript name | Segment starting position | Segment ending position |
|---|---|---|
| M62096_PEA_1_T5 (SEQ ID NO:66) | 1346 | 1406 |
| M62096_PEA_1_T9 (SEQ ID NO:69) | 380 | 440 |

Segment cluster M62096_PEA_1_node_33 (SEQ ID NO:646) according to the present invention is supported by 20 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T13 (SEQ ID NO:71) and M62096_PEA_1_T14 (SEQ ID NO:72). Table 640 below describes the starting and ending position of this segment on each transcript.

TABLE 640

Segment location on transcripts

| Transcript name | Segment starting position | Segment ending position |
|---|---|---|
| M62096_PEA_1_T4 (SEQ ID NO:65) | 1856 | 1924 |
| M62096_PEA_1_T5 (SEQ ID NO:66) | 1732 | 1800 |
| M62096_PEA_1_T6 (SEQ ID NO:67) | 705 | 773 |
| M62096_PEA_1_T7 (SEQ ID NO:68) | 727 | 795 |
| M62096_PEA_1_T9 (SEQ ID NO:69) | 766 | 834 |
| M62096_PEA_1_T13 (SEQ ID NO:71) | 1689 | 1757 |
| M62096_PEA_1_T14 (SEQ ID NO:72) | 1689 | 1757 |

Segment cluster M62096_PEA_1_node_42 (SEQ ID NO:647) according to the present invention is supported by 17 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 641 below describes the starting and ending position of this segment on each transcript.

TABLE 641

Segment location on transcripts

| Transcript name | Segment starting position | Segment ending position |
|---|---|---|
| M62096_PEA_1_T4 (SEQ ID NO:65) | 2468 | 2585 |
| M62096_PEA_1_T5 (SEQ ID NO:66) | 2344 | 2461 |
| M62096_PEA_1_T6 (SEQ ID NO:67) | 1317 | 1434 |
| M62096_PEA_1_T7 (SEQ ID NO:68) | 1339 | 1456 |
| M62096_PEA_1_T9 (SEQ ID NO:69) | 1378 | 1495 |
| M62096_PEA_1_T13 (SEQ ID NO:71) | 2301 | 2418 |

Segment cluster M62096_PEA_1_node_44 (SEQ ID NO:648) according to the present invention is supported by 19 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 642 below describes the starting and ending position of this segment on each transcript.

TABLE 642

Segment location on transcripts

| Transcript name | Segment starting position | Segment ending position |
|---|---|---|
| M62096_PEA_1_T4 (SEQ ID NO:65) | 2586 | 2662 |

TABLE 642-continued

Segment location on transcripts

| Transcript name | Segment starting position | Segment ending position |
|---|---|---|
| M62096_PEA_1_T5 (SEQ ID NO:66) | 2462 | 2538 |
| M62096_PEA_1_T6 (SEQ ID NO:67) | 1435 | 1511 |
| M62096_PEA_1_T7 (SEQ ID NO:68) | 1457 | 1533 |
| M62096_PEA_1_T9 (SEQ ID NO:69) | 1496 | 1572 |
| M62096_PEA_1_T13 (SEQ ID NO:71) | 2419 | 2495 |

Segment cluster M62096_PEA_1_node_47 (SEQ ID NO:649) according to the present invention is supported by 21 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T13 (SEQ ID NO:71). Table 643 below describes the starting and ending position of this segment on each transcript.

TABLE 643

Segment location on transcripts

| Transcript name | Segment starting position | Segment ending position |
|---|---|---|
| M62096_PEA_1_T4 (SEQ ID NO:65) | 2663 | 2772 |
| M62096_PEA_1_T5 (SEQ ID NO:66) | 2539 | 2648 |
| M62096_PEA_1_T6 (SEQ ID NO:67) | 1512 | 1621 |
| M62096_PEA_1_T7 (SEQ ID NO:68) | 1534 | 1643 |
| M62096_PEA_1_T9 (SEQ ID NO:69) | 1573 | 1682 |
| M62096_PEA_1_T13 (SEQ ID NO:71) | 2496 | 2605 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 644.

TABLE 644

Oligonucleotides related to this segment

| Oligonucleotide name | Overexpressed in cancers | Chip reference |
|---|---|---|
| M62096_0_7_0 (SEQ ID NO:231) | lung malignant tumors | LUN |

Segment cluster M62096_PEA_1_node_51 (SEQ ID NO:650) according to the present invention is supported by 11 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 645 below describes the starting and ending position of this segment on each transcript.

TABLE 645

Segment location on transcripts

| Transcript name | Segment starting position | Segment ending position |
|---|---|---|
| M62096_PEA_1_T4 (SEQ ID NO:65) | 2773 | 2874 |
| M62096_PEA_1_T5 (SEQ ID NO:66) | 2649 | 2750 |
| M62096_PEA_1_T6 (SEQ ID NO:67) | 1622 | 1723 |
| M62096_PEA_1_T7 (SEQ ID NO:68) | 1644 | 1745 |
| M62096_PEA_1_T9 (SEQ ID NO:69) | 1683 | 1784 |
| M62096_PEA_1_T11 (SEQ ID NO:70) | 689 | 790 |
| M62096_PEA_1_T15 (SEQ ID NO:73) | 689 | 790 |

Segment cluster M62096_PEA_1_node_53 (SEQ ID NO:651) according to the present invention is supported by 10 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 646 below describes the starting and ending position of this segment on each transcript.

TABLE 646

Segment location on transcripts

| Transcript name | Segment starting position | Segment ending position |
|---|---|---|
| M62096_PEA_1_T4 (SEQ ID NO:65) | 2875 | 2935 |
| M62096_PEA_1_T5 (SEQ ID NO:66) | 2751 | 2811 |
| M62096_PEA_1_T6 (SEQ ID NO:67) | 1724 | 1784 |
| M62096_PEA_1_T7 (SEQ ID NO:68) | 1746 | 1806 |
| M62096_PEA_1_T9 (SEQ ID NO:69) | 1785 | 1845 |
| M62096_PEA_1_T11 (SEQ ID NO:70) | 791 | 851 |
| M62096_PEA_1_T15 (SEQ ID NO:73) | 791 | 851 |

Segment cluster M62096_PEA_1_node_55 (SEQ ID NO:652) according to the present invention is supported by 9 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69), M62096_PEA_1_T11 (SEQ ID NO:70) and M62096_PEA_1_T15 (SEQ ID NO:73). Table 647 below describes the starting and ending position of this segment on each transcript.

TABLE 647

Segment location on transcripts

| Transcript name | Segment starting position | Segment ending position |
|---|---|---|
| M62096_PEA_1_T4 (SEQ ID NO:65) | 2936 | 3007 |
| M62096_PEA_1_T5 (SEQ ID NO:66) | 2812 | 2883 |
| M62096_PEA_1_T6 (SEQ ID NO:67) | 1785 | 1856 |
| M62096_PEA_1_T7 (SEQ ID NO:68) | 1807 | 1878 |
| M62096_PEA_1_T9 (SEQ ID NO:69) | 1846 | 1917 |
| M62096_PEA_1_T11 (SEQ ID NO:70) | 852 | 923 |
| M62096_PEA_1_T15 (SEQ ID NO:73) | 852 | 923 |

Segment cluster M62096_PEA_1_node_58 (SEQ ID NO:653) according to the present invention is supported by 9 libraries. The number of libraries was determined as previously described. This segment can be found in the following transcript(s): M62096_PEA_1_T4 (SEQ ID NO:65), M62096_PEA_1_T5 (SEQ ID NO:66) M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 648 below describes the starting and ending position of this segment on each transcript.

TABLE 648

Segment location on transcripts

| Transcript name | Segment starting position | Segment ending position |
|---|---|---|
| M62096_PEA_1_T4 (SEQ ID NO:65) | 3008 | 3112 |
| M62096_PEA_1_T5 (SEQ ID NO:66) | 2884 | 2988 |
| M62096_PEA_1_T6 (SEQ ID NO:67) | 1857 | 1961 |
| M62096_PEA_1_T7 (SEQ ID NO:68) | 1879 | 1983 |
| M62096_PEA_1_T9 (SEQ ID NO:69) | 1918 | 2022 |
| M62096_PEA_1_T11 (SEQ ID NO:70) | 924 | 1028 |

Segment cluster M62096_PEA_1_node_62 (SEQ ID NO:654) according to the present invention is supported by 14 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 649 below describes the starting and ending position of this segment on each transcript.

TABLE 649

Segment location on transcripts

| Transcript name | Segment starting position | Segment ending position |
|---|---|---|
| M62096_PEA_1_T4 (SEQ ID NO:65) | 3330 | 3443 |
| M62096_PEA_1_T5 (SEQ ID NO:66) | 3206 | 3319 |
| M62096_PEA_1_T6 (SEQ ID NO:67) | 2179 | 2292 |
| M62096_PEA_1_T7 (SEQ ID NO:68) | 2201 | 2314 |
| M62096_PEA_1_T9 (SEQ ID NO:69) | 2240 | 2353 |
| M62096_PEA_1_T11 (SEQ ID NO:70) | 1246 | 1359 |

Segment cluster M62096_PEA_1_node_66 (SEQ ID NO:655) according to the present invention is supported by 23 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 650 below describes the starting and ending position of this segment on each transcript.

TABLE 650

Segment location on transcripts

| Transcript name | Segment starting position | Segment ending position |
|---|---|---|
| M62096_PEA_1_T4 (SEQ ID NO:65) | 4764 | 4881 |
| M62096_PEA_1_T5 (SEQ ID NO:66) | 4640 | 4757 |
| M62096_PEA_1_T6 (SEQ ID NO:67) | 3613 | 3730 |
| M62096_PEA_1_T7 (SEQ ID NO:68) | 3635 | 3752 |
| M62096_PEA_1_T9 (SEQ ID NO:69) | 3674 | 3791 |
| M62096_PEA_1_T11 (SEQ ID NO:70) | 2680 | 2797 |

Segment cluster M62096_PEA_1_node_67 (SEQ ID NO:656) according to the present invention can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 651 below describes the starting and ending position of this segment on each transcript.

TABLE 651

Segment location on transcripts

| Transcript name | Segment starting position | Segment ending position |
|---|---|---|
| M62096_PEA_1_T4 (SEQ ID NO:65) | 4882 | 4887 |
| M62096_PEA_1_T5 (SEQ ID NO:66) | 4758 | 4763 |

TABLE 651-continued

Segment location on transcripts

| Transcript name | Segment starting position | Segment ending position |
|---|---|---|
| M62096_PEA_1_T6 (SEQ ID NO:67) | 3731 | 3736 |
| M62096_PEA_1_T7 (SEQ ID NO:68) | 3753 | 3758 |
| M62096_PEA_1_T9 (SEQ ID NO:69) | 3792 | 3797 |
| M62096_PEA_1_T11 (SEQ ID NO:70) | 2798 | 2803 |

Segment cluster M62096_PEA_1_node_68 (SEQ ID NO:657) according to the present invention can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 652 below describes the starting and ending position of this segment on each transcript.

TABLE 652

Segment location on transcripts

| Transcript name | Segment starting position | Segment ending position |
|---|---|---|
| M62096_PEA_1_T4 (SEQ ID NO:65) | 4888 | 4893 |
| M62096_PEA_1_T5 (SEQ ID NO:66) | 4764 | 4769 |
| M62096_PEA_1_T6 (SEQ ID NO:67) | 3737 | 3742 |
| M62096_PEA_1_T7 (SEQ ID NO:68) | 3759 | 3764 |
| M62096_PEA_1_T9 (SEQ ID NO:69) | 3798 | 3803 |
| M62096_PEA_1_T11 (SEQ ID NO:70) | 2804 | 2809 |

Segment cluster M62096_PEA_1_node_70 (SEQ ID NO:658) according to the present invention is supported by 55 libraries. The number of libraries was determined as previously described. This segment can be found in the following transcript(s): M62096_PEA_1_T4 (SEQ ID NO:65), M62096_PEA_1_T5 (SEQ ID NO:66), M62096_PEA_1_T6 (SEQ ID NO:67), M62096_PEA_1_T7 (SEQ ID NO:68), M62096_PEA_1_T9 (SEQ ID NO:69) and M62096_PEA_1_T11 (SEQ ID NO:70). Table 653 below describes the starting and ending position of this segment on each transcript.

TABLE 653

Segment location on transcripts

| Transcript name | Segment starting position | Segment ending position |
|---|---|---|
| M62096_PEA_1_T4 (SEQ ID NO:65) | 5827 | 5881 |
| M62096_PEA_1_T5 (SEQ ID NO:66) | 5703 | 5757 |
| M62096_PEA_1_T6 (SEQ ID NO:67) | 4676 | 4730 |
| M62096_PEA_1_T7 (SEQ ID NO:68) | 4698 | 4752 |
| M62096_PEA_1_T9 (SEQ ID NO:69) | 4737 | 4791 |
| M62096_PEA_1_T11 (SEQ ID NO:70) | 3743 | 3797 |

Variant protein alignment to the previously known protein:

Sequence name: KF5C_HUMAN (SEQ ID NO:1438)

Sequence documentation:

Alignment of: M62096_PEA_1_P4 (SEQ ID NO:1341) x KF5C_HUMAN (SEQ ID NO:1438)

Alignment segment 1/1:

| Quality: | 6936.00 | Escore: | 0 |
|---|---|---|---|
| Matching length: | 719 | Total length: | 719 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  7 VSKTGAEGAVLDEAKNINKSLSALGNVISALAEGTKTHVPYRDSKMTRIL   56
    ||||||||||||||||||||||||||||||||||||||||||||||||||
239 VSKTGAEGAVLDEAKNINKSLSALGNVISALAEGTKTHVPYRDSKMTRIL  288

57 QDSLGGNCRTTIVICCSPSVFNEAETKSTLMFGQRAKTIKNTVSVNLELT  106
    |||||||||||||||||||||||||||||||||||||||||||||||||
289 QDSLGGNCRTTIVICCSPSVFNEAETKSTLMFGQRAKTIKNTVSVNLELT  338

107 AEEWKKKYEKEKEKNKTLKNVIQHLEMELNRWRNGEAVPEDEQISAKDQK  156
    |||||||||||||||||||||||||||||||||||||||||||||||||
339 QELNSEIAKLNLKIEACKKSIENAKQDLLQLKNVISQTEHSYKELMAQNQ  388

157 NLEPCDNTPIIDNIAPVVAGISTEEKEKYDEEISSLYRQLDDKDDEINQQ  206
    |||||||||||||||||||||||||||||||||||||||||||||||||
389 NLEPCDNTPIIDNIAPVVAGISTEEKEKYDEEISSLYRQLDDKDDEINQQ  438
```

-continued

```
207  SQLAEKLKQQMLDQDELLASTRRDYEKIQEELTRLQIENEAAKDEVKEVL  256
     |||||||||||||||||||||||||||||||||||||||||||||||||
439  SQLAEKLKQQMLDQDELLASTRRDYEKIQEELTRLQIENEAAKDEVKEVL  488

257  QALEELAVNYDQKSQEVEDKTRANEQLTDELAQKTTTLTTTORELSQLQE  306
     |||||||||||||||||||||||||||||||||||||||||||||||||
489  QALEELAVNYDQKSQEVEDKTRANEQLTDELAQKTTTLTTTORELSQLQE  538

307  LSNHQKKRATEILNLLLKDLGEIGGIIGTNDVKTLADVNGVIEEEFTMAR  356
     |||||||||||||||||||||||||||||||||||||||||||||||||
539  LSNHQKKRATEILNLLLKDLGEIGGIIGTNDVKTLADVNGVIEEEFTMAR  588

357  LYISKMKSEVKSLVNRSKQLESAQMDSNRKMNASERELAAXALLISQHEA  406
     |||||||||||||||||||||||||||||||||||||||||||||||||
589  LYISKMKSEVKSLVNRSKQLESAQMDSNRKMNASERELAAXALLISQHEA  638

407  KIKSLTDYMQNMEQKRRQLEESQDSLSEELAKLRAQEKMHEVSFQDKEKE  456
     |||||||||||||||||||||||||||||||||||||||||||||||||
639  KIKSLTDYMQNMEQKRRQLEESQDSLSEELAKLRAQEKMHEVSFQDKEKE  688

457  HLTRLQDAEEMKKALEQQMESHREAHQKQLSRLRDEIEEKQKIIDEIRDL  506
     |||||||||||||||||||||||||||||||||||||||||||||||||
689  HLTRLQDAEEMKKALEQQMESHREAHQKQLSRLRDEIEEKQKIIDEIRDL  738

507  NQKLQLEQEKLSSDYNKLKIEDQEREMKLEKLLLLNDKREQAREDLKGLE  556
     |||||||||||||||||||||||||||||||||||||||||||||||||
739  NQKLQLEQEKLSSDYNKLKIEDQEREMKLEKLLLLNDKREQAREDLKGLE  788

557  ETVSRELQTLHNLRKLFVQDLTTRVKKSVELDNDDGGGSAAQKQKISFLE  606
     |||||||||||||||||||||||||||||||||||||||||||||||||
789  ETVSRELQTLHNLRKLFVQDLTTRVKKSVELDNDDGGGSAAQKQKISFLE  838

607  NNLEQLTKVHKQLVRDNADLRCELPKLEKRLRATAERVKALESALKEAKE  656
     |||||||||||||||||||||||||||||||||||||||||||||||||
839  NNLEQLTKVHKQLVRDNADLRCELPKLEKRLRATAERVKALESALKEAKE  888

657  NAMRDRKRYQQEVDRIKEAVRAKNMARRAHSAQIAKPIRPGHYPASSPTA  706
     |||||||||||||||||||||||||||||||||||||||||||||||||
889  NAMRDRKRYQQEVDRIKEAVRAKNMARRAHSAQIAKPIRPGHYPASSPTA  938

707  VHAIRGGGGSSSNSTHYQK                                725
     |||||||||||||||||||
939  VHAIRGGGGSSSNSTHYQK                                957
```

Sequence name: KF5C_HUMAN (SEQ ID NO:1438)

Sequence documentation:

Alignment of: M62096_PEA_1_P5 (SEQ ID NO:1342) x KF5C_HUMAN (SEQ ID NO:1438)

Alignment segment 1/1:

| Quality: | 6520.00 | Escore: | 0 |
|---|---|---|---|
| Matching length: | 674 | Total length: | 674 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MTRILQDSLGGNCRTTIVICCSPSVFNEAETKSTLMFGQRAKTIKNTVSV   50
     ||||||||||||||||||||||||||||||||||||||||||||||||||
284  MTRILQDSLGGNCRTTIVICCSPSVFNEAETKSTLMFGQRAKTIKNTVSV  333

51  NLELTAEEWKKKYEKEKEKNKTLKNVIQHLEMELNRWRNGEAVPEDEQIS  100
     ||||||||||||||||||||||||||||||||||||||||||||||||||
334  NLELTAEEWKKKYEKEKEKNKTLKNVIQHLEMELNRWRNGEAVPEDEQIS  383

101  AKDQKNLEPCDNTPIIDNIAPVVAGISTEEKEKYDEEISSLYRQLDDKDD  150
     ||||||||||||||||||||||||||||||||||||||||||||||||||
384  AKDQKNLEPCDNTPIIDNIAPVVAGISTEEKEKYDEEISSLYRQLDDKDD  433

151  EINQQSQLAEKLKQQMLDQDELLASTRRDYEKIQEELTRLQIENEAAKDE  200
     ||||||||||||||||||||||||||||||||||||||||||||||||||
434  EINQQSQLAEKLKQQMLDQDELLASTRRDYEKIQEELTRLQIENEAAKDE  483
```

```
201  VKEVLQALEELAVNYDQKSQEVEDKTRANEQLTDELAQKTTTLTTTQREL  250
     ||||||||||||||||||||||||||||||||||||||||||||||||||
484  VKEVLQALEELAVNYDQKSQEVEDKTRANEQLTDELAQKTTTLTTTQREL  533

251  SQLQELSNHQKKRATEILNLLLKDLGEIGGIIGTNDVKTLADVNGVIEEE  300
     ||||||||||||||||||||||||||||||||||||||||||||| ||||
534  SQLQELSNHQKKRATEILNLLLKDLGEIGGIIGTNDVKTLADVNGEIEEE  583

301  FTMARLYISKMKSEVKSLVNRSKQLESAQMDSNRKMNASERELAACQLLI  350
     ||||||||||||||||||||||||||||||||||||||||||||||||||
584  FTMARLYISKMKSEVKSLVNRSKQLESAQMDSNRKMNASERELAACQLLI  633

351  SQHEAKIKSLTDYMQNMEQKRRQLEESQDSLSEELAKLRAQEKMHEVSFQ  400
     ||||||||||||||||||||||||||||||||||||||||||||||||||
634  SQHEAKIKSLTDYMQNMEQKRRQLEESQDSLSEELAKLRAQEKMHEVSFQ  683

401  DKEKEHLTRLQDAEEMKKALEQQMESHREAHQKQLSRLRDEIEEKQKIID  450
     ||||||||||||||||||||||||||||||||||||||||||||||||||
684  DKEKEHLTRLQDAEEMKKALEQQMESHREAHQKQLSRLRDEIEEKQKIID  733

451  EIRDLNQKLQLEQEKLSSDYNKLKIEDQEREMKLEKLLLLNDKREQARED  500
     ||||||||||||||||||||||||||||||||||||||||||||||||||
734  EIRDLNQKLQLEQEKLSSDYNKLKIEDQEREMKLEKLLLLNDKREQARED  783

501  LKGLEETVSRELQTLHNLRKLFVQDLTTRVKKSVELDNDDFFFSAAQKQK  550
     ||||||||||||||||||||||||||||||||||||||||||||||||||
784  LKGLEETVSRELQTLHNLRKLFVQDLTTRVKKSVELDNDDFFFSAAQKQK  833

551  ISFLENNLEQLTKVHKQLVRDNADLRCELPKLEKRLRATAERVKALESAL  600
     ||||||||||||||||||||||||||||||||||||||||||||||||||
834  ISFLENNLEQLTKVHKQLVRDNADLRCELPKLEKRLRATAERVKALESAL  883

601  KEAKENAMRDRKRYQQEVDRIKEAVRAKNMARRAHSAQIAKPIRPGHYPA  650
     ||||||||||||||||||||||||||||||||||||||||||||||||||
884  KEAKENAMRDRKRYQQEVDRIKEAVRAKNMARRAHSAQIAKPIRPGHYPA  933

651  SSPTAVHAIRGGGGSSSNSTHYQK                            674
     ||||||||||||||||||||||||
934  SSPTAVHAIRGGGGSSSNSTHYQK                            957
```

Sequence name: KF5C_HUMAN (SEQ ID NO:1438)

Sequence documentation:

Alignment of: M62096_PEA__1_P3 (SEQ ID NO:1343) x KF5C_HUMAN (SEQ ID NO:1438)

Alignment segment 1/1:

| Quality: | 5726.00 | Escore: | 0 |
|---|---|---|---|
| Matching length: | 593 | Total length: | 593 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MELNRWRNGEAVPEDEQISAKDQKNLEPCDNTPIIDNIAPVVAGISTEEK   50
     ||||||||||||||||||||||||||||||||||||||||||||||||||
365  MELNRWRNGEAVPEDEQISAKDQKNLEPCDNTPIIDNIAPVVAGISTEEK  414

51  EKYDEEISSLYRQLDDKDDEINQQSQLAEKLKQQMLDQDELLASTRRDYE  100
     ||||||||||||||||||||||||||||||||||||||||||||||||||
415  EKYDEEISSLYRQLDDKDDEINQQSQLAEKLKQQMLDQDELLASTRRDYE  464

101  KIQEELTRLQIENEAAKDEVKEVLQALEELAVNYDQKSQEVEDKTRANEQ  150
     ||||||||||||||||||||||||||||||||||||||||||||||||||
465  KIQEELTRLQIENEAAKDEVKEVLQALEELAVNYDQKSQEVEDKTRANEQ  514

151  LTDELAQKTTTLTTTQRELSQLQELSNHQKKRATEILNLLLKDLGEIGGI  200
     ||||||||||||||||||||||||||||||||||||||||||||||||||
515  LTDELAQKTTTLTTTQRELSQLQELSNHQKKRATEILNLLLKDLGEIGGI  564

201  IGTNDVKTLADVNGVIEEEFTMARLYISKMKSEVKSLVNRSKQLESAQMD  250
     ||||||||||||||||||||||||||||||||||||||||||||||||||
565  IGTNDVKTLADVNGVIEEEFTMARLYISKMKSEVKSLVNRSKQLESAQMD  614
```

-continued

```
251  SNRKMNASERELAACQLLISQHEAKIKSLTDYMQNMEQKRRQLEESQDSL  300
     ||||||||||||||||||||||||||||||||||||||||||||||||||
615  SNRLMNASERELAACQLLISQHEAKIKSLTDYMQNMEQKRRQLEESQDSL  664

301  SEELAKLRAQEKMHEVSFQDKEKEHLTRLQDAEEMKKALEQQMESHREAH  350
     |||||||||||||||||||||||||||||||||||||||||||||||||
665  SEELAKLRAQEKMHEVSFQDKEKEHLTRLQDAEEMKKALEQQMESHREAH  714

351  QKQLSRLRDEIEEKQKIIDEIRDLNQKLQLEQEKLSSDYNKLKIEDQERE  400
     |||||||||||||||||||||||||||||||||||||||||||||||||
715  QKQLSRLRDEIEEKQKIIDEIRDLNQKLQLEQEKLSSDYNKLKIEDQERE  764

401  MKLEKLLLLNDKREQAREDLKGLEETVSRELQTLHNLRKLFVQDLTTRVK  450
     |||||||||||||||||||||||||||||||||||||||||||||||||
765  MKLEKLLLLNDKREQAREDLKGLEETVSRELQTLHNLRKLFVQDLTTRVK  814

451  KSVELDNDDGGGSAAQKQKISFLENNLEQLTKVHKQLVRDNADLRCELPK  500
     |||||||||||||||||||||||||||||||||||||||||||||||||
815  KSVELDNDDGGGSAAQKQKISFLENNLEQLTKVHKQLVRDNADLRCELPK  864

501  LEKRLRATAERVKALESALKEAKENAMRDRKRYQQEVDRIKEAVRAKNMA  550
     |||||||||||||||||||||||||||||||||||||||||||||||||
865  LEKRLRATAERVKALESALKEAKENAMRDRKRYQQEVDRIKEAVRAKNMA  914

551  RRAHSAQIAKPIRPGHYPASSPTAVHAIRGGGGSSSNSTHYQK        593
     ||||||||||||||||||||||||||||||||||||||||||
915  RRAHSAQIAKPIRPGHYPASSPTAVHAIRGGGGSSSNSTHYQK        957
```

Sequence name: KF5C_HUMAN (SEQ ID NO:1438)

Sequence documentation:

Alignment of: M62096_PEA_1_P7 (SEQ ID NO:1344) x KF5C_HUMAN (SEQ ID NO:1438)

Alignment segment 1/1:

| Quality: | 2117.00 | Escore: | 0 |
|---|---|---|---|
| Matching length: | 220 | Total length: | 220 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

Sequence name: KF5C_HUMAN (SEQ ID NO:1438)

Sequence documentation:

Alignment of: M62096_PEA_1_P8 (SEQ ID NO:1345) x KF5C_HUMAN (SEQ ID NO:1438)

Alignment segment 1/1:

| Quality: | 7146.00 | Escore: | 0 |
|---|---|---|---|
| Matching length: | 737 | Total length: | 737 |
| Matching Percent Similarity: | 100.00 | Matching Percent Identity: | 99.86 |
| Total Percent Similarity: | 100.00 | Total Percent Identity: | 99.86 |
| Gaps: | 0 | | |

```
20   LNQKLQLEQEKLSSDYNKLKIEDQEREMKLEKLLLLNDKREQAREDLKGL  69
     |||||||||||||||||||||||||||||||||||||||||||||||||
738  LNQKLQLEQEKLSSDYNKLKIEDQEREMKLEKLLLLNDKREQAREDLKGL  787

70   EETVSRELQTLHNLRKLFVQDLTTRVKKSVELDNDDGGGSAAQKQKISFL  119
     |||||||||||||||||||||||||||||||||||||||||||||||||
188  EETVSRELQTLHNLRKLFVQDLTTRVKKSVELDNDDGGGSAAQKQKISFL  837

120  ENNLEQLTKVHKQLVRDNADLRCELPKLEKRLRATAERVKALESALKEAK  169
     |||||||||||||||||||||||||||||||||||||||||||||||||
838  ENNLEQLTKVHKQLVRDNADLRCELPKLEKRLRATAERVKALESALKEAK  887

170  ENAMRDRKRYQQEVDRIKEAVRAKNMARRAHSAQIAKPIRPGHYPASSPT  219
     ||||||||| |||||||||||||||||||||||||||||||||||||||
888  ENAMRDRKEYQQEVDRIKEAVRAKNMARRAHSAQIAKPIRPGHYPASSPT  937

220  AVHAIRGGGGSSSNSTHYQK  239
     ||||||||||||||||||||
938  AVHAIRGGGGSSSNSTHYQK  957
```

Alignment:

```
  1 MADPAECSIKVMCRFRPLNEAEILRGDKFIPKFKGDETVVIGQGKPYVFD   50
    ||||||||||||||||||||||||||||||||||||||||||||||||||
  1 MADPAECSIKVMCRFRPLNEAEILRGDKFIPKFKGDETVVIGQGKPYVFD   50

51 RVLPPNTTQEQVYNACAKQIVKDVLEGUNGTIFAYGQTSSKGTHTMEGKL  100
    ||||||||||||||||||||||||||||||||||||||||||||||||||
 51 RVLPPNTTQEQVYNACAKQIVKDVLEGUNGTIFAYGQTSSKGTHTMEGKL  100

101 HDPQLMGIIPRIAHDIFDHIYSMDENLEFHIKVSYFEIYLDKIRDLLDVS  150
    ||||||||||||||||||||||||||||||||||||||||||||||||||
101 HDPQLMGIIPRIAHDIFDHIYSMDENLEFHIKVSYFEIYLDKIRDLLDVS  150

151 KTNLAVHEDKNRVPYVKGCTERFVSSPEEVMDVIDEGKANHRVAVTNMNE  200
    |||||||||||||||||||||||||||||  |||||||||||||||||||
151 KTNLAVHEDKNRVPYVKGCTERFVSSPRRVMDVIDEGKANHRVAVTNMNE  200

201 HSSRSHSIFLINIKQENVETEKKLSGKLYLVDLAGSEKVSKTGAEGAVLD  250
    ||||||||||||||||||||||||||||||||||||||||||||||||||
201 HSSRSHSIFLINIKQENVETEKKLSGKLYLVDLAGSEKVSKTGAEGAVLD  250

251 EAKNINKSLSALGNVISALAEGTKTHVPYRDSKMTRILQDSLGGNCRTTI  300
    |||||||||||||||||||||||||||||||||||| |||||||||||||
251 EAKNINKSLSALGNVISALAEGTKTHVPYRDSKMTHILQDSLGGNCRTTI  300

301 VICCSPSVFNEAETKSTLMFGQRAKTIKNTVSVNLELTAEEWKKKYEKEK  350
    ||||||||||||||||||||||||||||||||||||||||||||||||||
301 VICCSPSVFNEAETKSTLMFGQRAKTIKNTVSVNLELTAEEWKKKYEKEK  350

351 EKNKTLKNVIQHLEMELNRWRNGEAVPEDEQISAKDQKNLEPCDNTPIID  400
    ||||||||||||||||||||||||||||||||||||||||||||||||||
351 EKNKTLKNVIQHLEMELNRWRNGEAVPEDEQISAKDQKNLEPCDNTPIID  400

401 NIAPVVAGISTEEKEKYDEEISSLYRQLDDKDDEINQQSQLAEKLKQQML  450
    ||||||||||||||||||||||||||||||||||||||||||||||||||
401 NIAPVVAGISTEEKEKYDEEISSLYRQLDDKDDEINQQSQLAEKLKQQML  450

451 DQDELLASTRRDYEKIQEELTRLQIENEAAKDEVKEVLQALEELAVNYDQ  500
    ||||||||||||||||||||||||||||||||||||||||||||||||||
451 DQDELLASTRRDYEKIQEELTRLQIENEAAKDEVKEVLQALEELAVNYDQ  500

501 KSQEVEDKTRANEQLTDELAQKTTTLTTTQRELSQLQELSNHQKKRATEI  550
    ||||||||||||||||||||||||||||||||||||||||||||||||||
501 KSQEVEDKTRANEQLTDELAQKTTTLTTTQRELSQLQELSNHQKKRATEI  550

551 LNLLLKDLGEIGGIIGTNDVKTLADVNGVIEEEFTMARLYISKMKSEVKS  600
    ||||||||||||||||||||||||||||||||||||||||||||||||||
551 LNLLLKDLGEIGGIIGTNDVKTLADVNGVIEEEFTMARLYISKMKSEVKS  600

601 LVNRSKQLESAQMDSNRKMNASERELAACQLLISQHEAKIKSLTDYMQNM  650
    ||||||||||||||||||||||||||||||||||||||||||||||||||
601 LVNRSKQLESAQMDSNRKMNASERELAACQLLISQHEAKIKSLTDYMQNM  650

651 EQKRRQLEESQDSLSEELAKLRAQEKMHEVSFQDKEKEHLTRLQDAEEMK  700
    ||||||||||||||||||||||||||||||||||||||||||||||||||
651 EQKRRQLEESQDSLSEELAKLRAQEKMHEVSFQDKEKEHLTRLQDAEEMK  700

701 KALEQQMESHREAHQKQLSRLRDEIEEKQKIIDEIRE              737
    |||||||||||||||||||||||||||||||||||:
701 KALEQQMESHREAHQKQLSRLRDEIEEKQKIIDEIRD              737
```

Sequence name: KF5C_HUMAN (SEQ ID NO:1438)

Sequence documentation:
Alignment of: M62096_PEA_1_P9 (SEQ ID NO:1346) x KF5C_HUMAN (SEQ ID NO:1438)

Alignment segment 1/1:

| | | | |
|---|---|---|---|
| Quality: | 4434.00 | Escore: | 0 |
| Matching length: | 454 | Total length: | 454 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MADPAECSIKVMCRFRPLNEAEILRGDKFIPKFKGDETVVIGQGKPYVFD  50
    ||||||||||||||||||||||||||||||||||||||||||||||||||
  1 MADPAECSIKVMCRFRPLNEAEILRGDKFIPKFKGDETVVIGQGKPYVFD  50

51 RVLPPNTTQEQVYNACAKQIVKDVLEGYNGTIFAYGQTSSGKTHTMEGKL 100
    ||||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    ||||||||||||||||||||||||||||||||||||||||||||||||||
101 HDPQLMGIIPRIAHDIFDHIYSMDENLEFHIKVSYFEIYLDKIRDLLDVS 150

151 KTNLAVHEDKNRVPYVKGCTERFVSSPEEVMDVIDEGKANRHVAVTNMNE 200
    ||||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    ||||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    ||||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQRAKTIKNTVSVNLELTAEEWKKKYEKEK 350
    ||||||||||||||||||||||||||||||||||||||||||||||||||
301 VICCSPSVFNEAETKSTLMFGQRAKTIKNTVSVNLELTAEEWKKKYEKEK 350

351 EKNKTLKNVIQHLEMELNRWRNGEAVPEDEQISAKDQKNLEPCDNTPIID 400
    ||||||||||||||||||||||||||||||||||||||||||||||||||
351 EKNKTLKNVIQHLEMELNRWRNGEAVPEDEQISAKDQKNLEPCDNTPIID 400

401 NIAPVVAGISTEEKEKYDEEISSLYRQLDDKDDEINQQSQLAEKLKQQML 450
    ||||||||||||||||||||||||||||||||||||||||||||||||||
401 NIAPVVAGISTEEKEKYDEEISSLYRQLDDKDDEINQQSQLAEKLKQQML 450

451 DQDE                                               454
    ||||
451 DQDE                                               454
```

Sequence name: KF5C_HUMAN (SEQ ID NO:1438)

Sequence documentation:

Alignment of: M62096_PEA__1_P10 (SEQ ID NO:1347) x KF5C_HUMAN (SEQ ID NO:1438) . . .

Alignment segment 1/1:

| Quality: | 747.00 | Escore: | 0 |
|---|---|---|---|
| Matching length: | 78 | Total length: | 78 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence name: KF5C_HUMAN (SEQ ID NO:1438)

Sequence documentation:

Alignment of: M62096_PEA__1_P11 (SEQ ID NO:1348) x KF5C_HUMAN (SEQ ID NO:1438) . . .

Alignment segment 1/1:

| Quality: | 3634.00 | Escore: | 0 |
|---|---|---|---|
| Matching length: | 372 | Total length: | 372 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 20 LNQKLQLEQEKLSSDYNKLKIEDQEREMKLEKLLLLNDKREQAREDLKGL  69
    ||||||||||||||||||||||||||||||||||||||||||||||||||
738 LNQKLQLEQEKLSSDYNKLKIEDQEREMKLEKLLLLNDKREQAREDLKGL 787

70 EETVSRELQTLHNLRKLFVQDLTTRVKK  97
    ||||||||||||||||||||||||||||
788 EETVSRELQTLHNLRKLFVQDLTTRVKK 815
```

Alignment:

```
  1 MADPAECSIKVMCRFRPLNEAEILRGDKFIPKFKGDETVVIGQGKPYVFD  50
    ||||||||||||||||||||||||||||||||||||||||||||||||||
  1 MADPAECSIKVMCRFRPLNEAEILRGDKFIPKFKGDETVVIGQGKPYVFD  50

51 RVLPPNTTQEQVYNACAKQIVKDVLEGYNGTIFAYGQTSSGKTHTMEGKL 100
    ||||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    ||||||||||||||||||||||||||||||||||||||||||||||||||
101 HDPQLMGIIPRIAHDIFDHIYSMDENLEFHIKVSYFEIYLDKIRDLLDVS 150

151 KTNLAVHEDKNRVPYVKGCTERFVSSPEEVMDVIDEGKANRHVAVTNMNE 200
    ||||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    ||||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    ||||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQRAKTIKNTVSVNLELTAEEWKKKYEKEK 350
    ||||||||||||||||||||||||||||||||||||||||||||||||||
301 VICCSPSVFNEAETKSTLMFGQRAKTIKNTVSVNLELTAEEWKKKYEKEK 350

351 EKNKTLKNVIQHLEMELNRWRN                             372
    ||||||||||||||||||||||
351 EKNKTLKNVIQHLEMELNRWRN                             372
```

Sequence name: KF5C_HUMAN (SEQ ID NO:1438)
Sequence documentation:
Alignment of: M62096_PEA_1_P12 (SEQ ID NO:1349) x KF5C_HUMAN (SEQ ID NO:1438) . . .

Alignment segment 1/1:

| | | | |
|---|---|---|---|
| Quality: | 3145.00 | Escore: | 0 |
| Matching length: | 323 | Total length: | 323 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MADPAECSIKVMCRFRPLNEAEILRGDKFIPKFKGDETVVIGQGKPYVFD  50
    ||||||||||||||||||||||||||||||||||||||||||||||||||
  1 MADPAECSIKVMCRFRPLNEAEILRGDKFIPKFKGDETVVIGQGKPYVFD  50

51 RVLPPNTTQEQVYNACAKQIVKDVLEGYNGTIFAYGQTSSGKTHTMEGKL 100
    ||||||||||||||||||||||||||||||||||||||||||||||||||
 51 RVLPPNTTQEQVYNACAKQIVKDVLEGYNGTIFAYGQTSSGKTHTMEGKL 100

101 HDPQLMGIIPRIAHDIFDHIYSMDENLEFHIKVSYFEIYLDKIRDLLDVS 150
    ||||||||||||||||||||||||||||||||||||||||||||||||||
101 HDPQLMGIIPRIAHDIFDHIYSMDENLEFHIKVSYFEIYLDKIRDLLDVS 150

151 KTNLAVHEDKNRVPYVKGCTERFVSSPEEVMDVIDEGKANRHVAVTNMNE 200
    ||||||||||||||||||||||||||||||||||||||||||||||||||
151 KTNLAVHEDKNRVPYVKGCTERFVSSPEEVMDVIDEGKANRHVAVTNMNE 200

201 HSSRSHSIFLINIKQENVETEKKLSGKLYLVDLAGSEKVSKTGAEGAVLD 250
    ||||||||||||||||||||||||||||||||||||||||||||||||||
201 HSSRSHSIFLINIKQENVETEKKLSGKLYLVDLAGSEKVSKTGAEGAVLD 250

251 EAKNINKSLSALGNVISALAEGTKTHVPYRDSKMTRILQDSLGGNCRTTI 300
    ||||||||||||||||||||||||||||||||||||||||||||||||||
251 EAKNINKSLSALGNVISALAEGTKTHVPYRDSKMTRILQDSLGGNCRTTI 300

301 VICCSPSVFNEAETKSTLMFGQR                            323
    |||||||||||||||||||||||
301 VICCSPSVFNEAETKSTLMFGQR                            323
```

Expression of *Homo Sapiens* Protein Tyrosine Phosphatase, Receptor Type, S (PTPRS) M62069 Transcripts which are Detectable by Amplicon as Depicted in Sequence Name M62069 seg19 (SEQ ID NO:1657) in Normal and Cancerous Lung Tissues Expression of *Homo Sapiens* protein tyrosine phosphatase, receptor type, S (PTPRS) transcripts detectable by or according to seg19, M62069 seg19 amplicon (SEQ ID NO:1657) and M62069 seg19F (SEQ ID NO:1655) and M62069 seg19R (SEQ ID NO:1656) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 65:
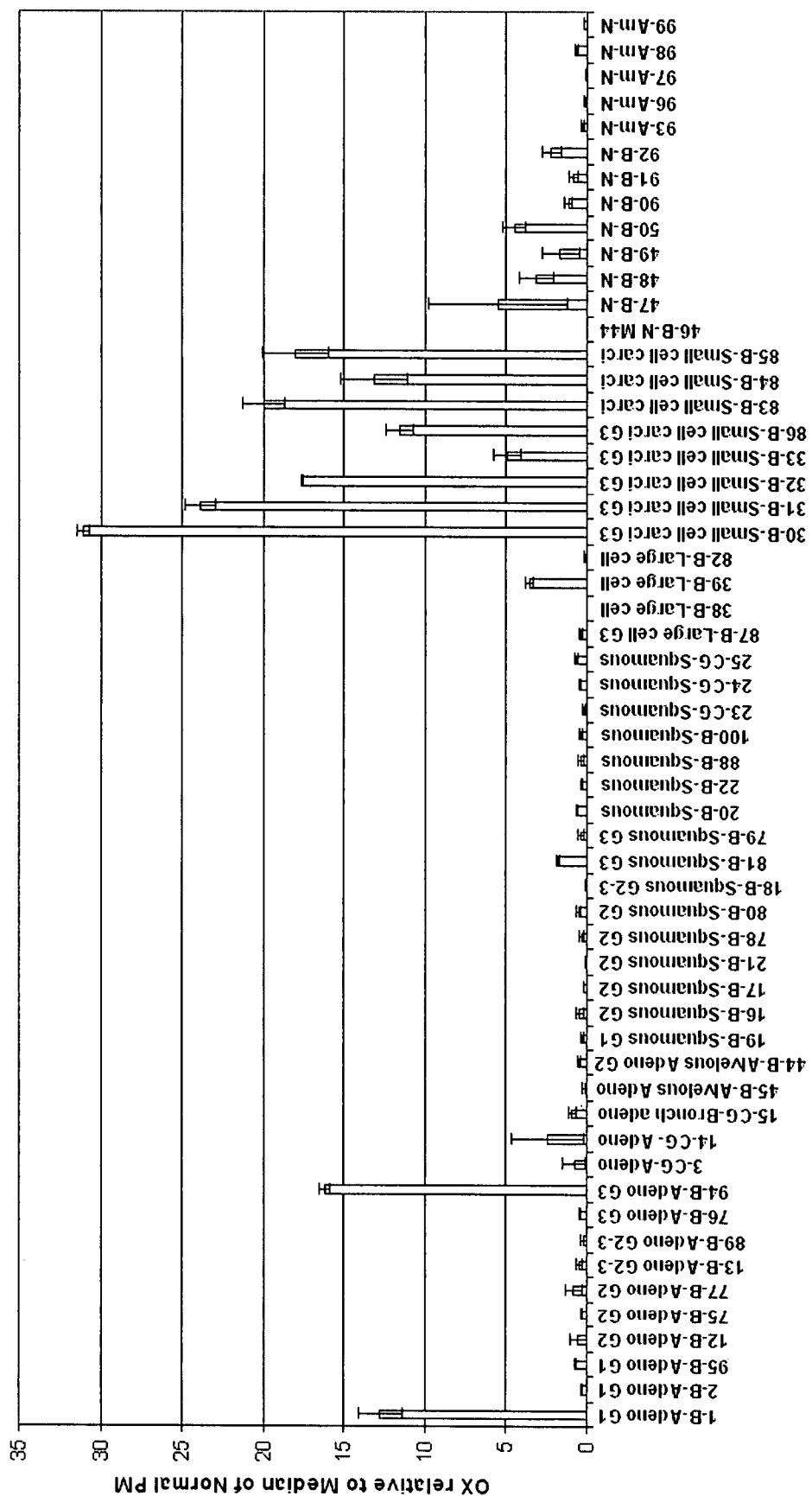
FIG. 65 is a histogram showing over expression of the protein tyrosine phosphatase, receptor type, S (PTPRS) M62069 transcripts, which are detectable by amplicon as depicted in sequence name M62069 seg19 (SEQ ID NO:1657), in cancerous lung samples relative to the normal samples.

FIG. 65 is a histogram showing over expression of the above-indicated *Homo sapiens* protein tyrosine phosphatase, receptor type, S (PTPRS) transcripts in cancerous lung samples relative to the normal samples. Values represent the average of duplicate experiments. Error bars indicate the minimal and maximal values obtained.

As is evident from FIG. 65, the expression of *Homo sapiens* protein tyrosine phosphatase, receptor type, S (PTPRS) transcripts detectable by the above amplicon(s) in cancer samples was significantly higher than in the non-cancerous samples (Sample Nos. 47-50, 90-93, 96-99 Table 2). Notably an over-expression of at least 5 fold was found in 2 out of 15 adenocarcinoma samples, and in 8 out of 8 small cells carcinoma samples.

Primer pairs are also optionally and preferably encompassed within the present invention; for example, for the above experiment, the following primer pair was used as a non-limiting illustrative example only of a suitable primer pair: M62069 seg19F forward primer (SEQ ID NO:1655); and M62069 seg19R reverse primer (SEQ ID NO: 1656).

The present invention also preferably encompasses any amplicon obtained through the use of any suitable primer pair; for example, for the above experiment, the following amplicon was obtained as a non-limiting illustrative example only of a suitable amplicon: M62069 seg19 (SEQ ID NO:1657).

Forward primer—M62069 seg19F (SEQ ID NO:1655): GCTGATTGTCCCCATGAAGG

Reverse primer—M62069 seg19 (SEQ ID NO:1656): TGGCATACGGGAACTCAGTG

Amplicon (SEQ ID NO:1657): GCTGATTGTCCCCATGAAGGCCAGCCTTGAAGCTTGGT-CAGTCTCCCTAACTGTATGATTGATCCCCA CTTAT-TGCACTACATCACTGAGTFCCCGTATGC Expression of *Homo Sapiens* Protein Tyrosine Phosphatase, Receptor Type, S (PTPRS) M62069 Transcripts which are Detectable by Amplicon as Depicted in Sequence Name M62069 seg29 (SEQ ID NO:1660) in Normal and Cancerous Lung Tissues Expression of *Homo sapiens* protein tyrosine phosphatase, receptor type, S (PTPRS) transcripts detectable by or according to seg29, M62069 seg29 amplicon (SEQ ID NO: 1660) and M62069 seg29F (SEQ ID NO: 1658) and M62069 seg29R (SEQ ID NO: 1659) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 66:
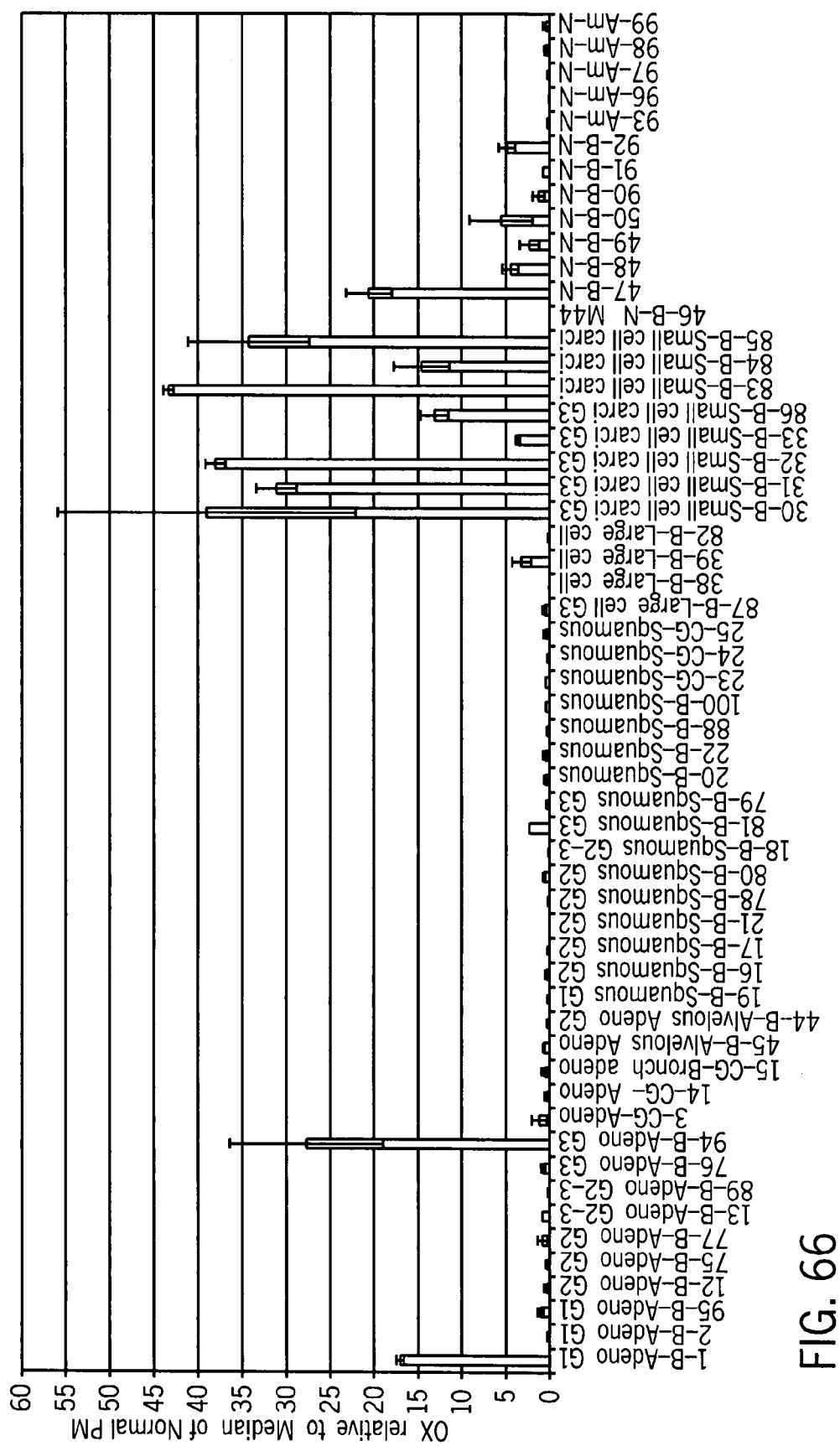
FIG. 66 is a histogram showing over expression of the protein tyrosine phosphatase, receptor type, S (PTPRS) M62069 transcripts, which are detectable by amplicon as depicted in sequence name M62069 seg29 (SEQ ID NO: 1660), in cancerous lung samples relative to the normal samples.

FIG. 66 is a histogram showing over expression of the above-indicated *Homo sapiens* protein tyrosine phosphatase, receptor type, S (PTPRS) transcripts in cancerous lung samples relative to the normal samples. Values represent the average of duplicate experiments. Error bars indicate the minimal and maximal values obtained.

As is evident from FIG. 66, the expression of *Homo sapiens* protein tyrosine phosphatase, receptor type, S (PTPRS) transcripts detectable by the above amplicon(s) in cancer samples was significantly higher than in the non-cancerous samples (Sample Nos. 47-50, 90-93, 96-99 Table 2). Notably an over-expression of at least 5 fold was found in 2 out of 15 adenocarcinoma samples, and in 7 out of 8 small cells carcinoma samples.

Primer pairs are also optionally and preferably encompassed within the present invention; for example, for the above experiment, the following primer pair was used as a non-limiting illustrative example only of a suitable primer pair: M62069 seg29F forward primer (SEQ ID NO: 1658); and M62069 seg29R reverse primer (SEQ ID NO: 1659).

The present invention also preferably encompasses any amplicon obtained through the use of any suitable primer pair; for example, for the above experiment, the following amplicon was obtained as a non-limiting illustrative example only of a suitable amplicon: M62069 seg29 (SEQ ID NO:1660).

Forward primer—M62069 seg29F: ATTGAATAAT-TCAGCACCTGAGGC

Reverse primer—M62069 seg29R: TTCATATGGC-TACTCCCCACCT

Amplicon: ATTGAATAATTCAGCACCTGAGGCTG-GTGGATGATTCTTTGCAATTTGGCAG-GAATGGGAGAGTCGG GAGCAGTAGTTGGCAAG-GTGGGGAGTAGCCATATGAA

Description for Cluster M78076

Cluster M78076 features 9 transcript(s) and 35 segment(s) of interest, the names for which are given in Tables 654 and 655, respectively, the sequences themselves are given at the end of the application. The selected protein variants are given in table 656.

TABLE 654

Transcripts of interest

| Transcript Name | Sequence ID No. |
| --- | --- |
| M78076_PEA_1_T2 | 74 |
| M78076_PEA_1_T3 | 75 |
| M78076_PEA_1_T5 | 76 |
| M78076_PEA_1_T13 | 77 |
| M78076_PEA_1_T15 | 78 |
| M78076_PEA_1_T23 | 79 |
| M78076_PEA_1_T26 | 80 |
| M78076_PEA_1_T27 | 81 |
| M78076_PEA_1_T28 | 82 |

TABLE 655

Segments of interest

| Segment Name | Sequence ID No. |
| --- | --- |
| M78076_PEA_1_node_0 | 659 |
| M78076_PEA_1_node_10 | 660 |
| M78076_PEA_1_node_15 | 661 |
| M78076_PEA_1_node_18 | 662 |
| M78076_PEA_1_node_20 | 663 |
| M78076_PEA_1_node_24 | 664 |
| M78076_PEA_1_node_26 | 665 |
| M78076_PEA_1_node_29 | 666 |
| M78076_PEA_1_node_32 | 667 |
| M78076_PEA_1_node_35 | 668 |
| M78076_PEA_1_node_37 | 669 |
| M78076_PEA_1_node_46 | 670 |
| M78076_PEA_1_node_47 | 671 |
| M78076_PEA_1_node_54 | 672 |
| M78076_PEA_1_node_1 | 673 |
| M78076_PEA_1_node_2 | 674 |
| M78076_PEA_1_node_3 | 675 |
| M78076_PEA_1_node_6 | 676 |
| M78076_PEA_1_node_7 | 677 |
| M78076_PEA_1_node_12 | 678 |
| M78076_PEA_1_node_22 | 679 |
| M78076_PEA_1_node_27 | 680 |
| M78076_PEA_1_node_30 | 681 |
| M78076_PEA_1_node_31 | 682 |
| M78076_PEA_1_node_34 | 683 |
| M78076_PEA_1_node_36 | 684 |
| M78076_PEA_1_node_41 | 685 |
| M78076_PEA_1_node_42 | 686 |
| M78076_PEA_1_node_43 | 687 |
| M78076_PEA_1_node_45 | 688 |
| M78076_PEA_1_node_49 | 689 |
| M78076_PEA_1_node_50 | 690 |
| M78076_PEA_1_node_51 | 691 |
| M78076_PEA_1_node_52 | 692 |
| M78076_PEA_1_node_53 | 693 |

TABLE 656

Proteins of interest

| Protein Name | Sequence ID No. | Corresponding Transcript(s) |
| --- | --- | --- |
| M78076_PEA_1_P3 | 1350 | M78076_PEA_1_T2 (SEQ ID NO:74); M78076_PEA_1_T5 (SEQ ID NO:76) |
| M78076_PEA_1_P4 | 1351 | M78076_PEA_1_T3 (SEQ ID NO:75) |
| M78076_PEA_1_P12 | 1352 | M78076_PEA_1_T13 (SEQ ID NO:77) |
| M78076_PEA_1_P14 | 1353 | M78076_PEA_1_T15 (SEQ ID NO:78) |
| M78076_PEA_1_P21 | 1354 | M78076_PEA_1_T23 (SEQ ID NO:79) |
| M78076_PEA_1_P24 | 1355 | M78076_PEA_1_T26 (SEQ ID NO:80) |
| M78076_PEA_1_P2 | 1356 | M78076_PEA_1_T27 (SEQ ID NO:81) |
| M78076_PEA_1_P25 | 1357 | M78076_PEA_1_T28 (SEQ ID NO:82) |

These sequences are variants of the known protein Amyloid-like protein 1 precursor (SwissProt accession identifier APP1_HUMAN; known also according to the synonyms APLP; APLP-1), SEQ ID NO:1439, referred to herein as the previously known protein.

Protein Amyloid-like protein 1 precursor (SEQ ID NO:1439) is known or believed to have the following function(s): May play a role in postsynaptic function. The C-terminal gamma-secretase processed fragment, ALID1, activates transcription activation through APBB1 (Fe65) binding (By similarity). Couples to JIP signal transduction through C-terminal binding. May interact with cellular G-protein signaling pathways. Can regulate neurite outgrowth through binding to components of the extracellular matrix such as heparin and collagen I. The gamma-CTF peptide, C30, is a potent enhancer of neuronal apoptosis (By similarity). The sequence for protein Amyloid-like protein 1 precursor is given at the end of the application, as "Amyloid-like protein 1 precursor amino acid sequence". Known polymorphisms for this sequence are as shown in Table 657.

TABLE 657

Amino acid mutations for Known Protein

| SNP position(s) on amino acid sequence | Comment |
| --- | --- |
| 48 | A -> P |

Protein Amyloid-like protein 1 precursor (SEQ ID NO:1439) localization is believed to be Type I membrane protein. C-terminally processed in the Golgi complex.

The following GO Annotation(s) apply to the previously known protein. The following annotation(s) were found: endocytosis; apoptosis; cell adhesion; neurogenesis; cell death, which are annotation(s) related to Biological Process; protein binding; heparin binding, which are annotation(s) related to Molecular Function; and basement membrane; coated pit; integral membrane protein, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster M78076 features 9 transcript(s), which were listed in Table 654 above. These transcript(s) encode for protein(s) which are variant(s) of protein Amyloid-like protein 1 precursor (SEQ ID NO:1439). A description of each variant protein according to the present invention is now provided.

Variant protein M78076_PEA_1_P3 (SEQ ID NO:1350) according to the present invention has an amino acid sequence as given at the end of the application; it is encoded by transcript(s) M78076_PEA_1_T2 (SEQ ID NO:74). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P3 (SEQ ID NO:1350) and APP1_HUMAN (SEQ ID NO:1439):

1. An isolated chimeric polypeptide encoding for M78076_PEA_1_P3 (SEQ ID NO:1350), comprising a first amino acid sequence being at least 90% homologous to MGPASPAARGLSRRPGQPPLPLLL-PLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTDG-VDIYFGMPGEISEHEGFLRAKMDLEERRMRQINE-VMREWAMADNQSKNLPKADRQALNE HFQSILQTLEEQVSGERQRLVETHATRVIALINDQRRA ALEGFLAALQADPPQAERVLLALRRYLRAEQKE QRHTLRHYQHVAAVDPEKAQQMRFQVHTHL-QVIEERVNQSLGLLDQNPHLAQELRPQIQELLHSEH-LGPS ELEAPAPGGSSEDKGGLQPPDSKD corresponding to amino acids 1-517 of APP1_HUMAN (SEQ ID NO:1439), which also corresponds to amino acids 1-517 of M78076_PEA_1_P3 (SEQ ID NO:1350), and a second amino acid sequence being at least 70%, optionally at least 80%, preferably at least 85%, more preferably at least 90% and most preferably at least 95% homologous to a polypeptide having the sequence GE corresponding to amino acids 518-519 of M78076_PEA_1_P3 (SEQ ID NO:1350), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P3 (SEQ ID NO:1350) also has the following non-silent SNPs (Single Nucleotide Polymorphisms) as listed in Table 658, (given according to their position(s) on the amino acid sequence, with the alternative amino acid(s) listed; the last column indicates whether the SNP is known or not; the presence of known SNPs in variant protein M78076_PEA_1_P3 (SEQ ID NO:1350) sequence provides support for the deduced sequence of this variant protein-according to the present invention).

TABLE 658

Amino acid mutations

| SNP position(s) on amino acid sequence | Alternative amino acid(s) | Previously know SNP? |
|---|---|---|
| 4 | A –> P | Yes |
| 6 | P –> H | Yes |
| 13 | R –> H | Yes |
| 34 | Q –> | No |
| 38 | G –> R | Yes |
| 88 | P –> R | Yes |
| 124 | R –> Q | Yes |
| 127 | S –> | No |
| 145 | F –> S | No |
| 214 | G –> R | No |
| 214 | G –> | No |
| 262 | Q –> | No |
| 270 | V –> | No |
| 309 | G –> E | Yes |
| 370 | Q –> | No |

The glycosylation sites of variant protein M78076_PEA_1_P3 (SEQ ID NO:1350), as compared to the known protein Amyloid-like protein 1 precursor (SEQ ID NO:1439), are described in Table 659 (given according to their position(s) on the amino acid sequence in the first column; the second column indicates whether the glycosylation site is present in the variant protein; and the last column indicates whether the position is different on the variant protein).

TABLE 659

Glycosylation site(s)

| Position(s) on known amino acid sequence | Present in variant protein? | Position in variant protein? |
|---|---|---|
| 337 | yes | 337 |
| 461 | yes | 461 |
| 551 | no | |

Variant protein M78076_PEA_1_P3 (SEQ ID NO:1350) is encoded by the following transcript(s): M78076_PEA_1_T2 (SEQ ID NO:74), for which the sequence(s) is/are given at the end of the application. The coding portion of transcript M78076_PEA_1_T2 (SEQ ID NO:74) is shown in bold; this coding portion starts at position 142 and ends at position 1698. The transcript also has the following SNPs as listed in Table 660 (given according to their position on the nucleotide sequence, with the alternative nucleic acid listed; the last column indicates whether the SNP is known or not; the presence of known SNPs in variant protein M78076_PEA_1_P3 (SEQ ID NO:1350) sequence provides support for the deduced sequence of this variant protein according to the present invention).

TABLE 660

Nucleic acid SNPs

| SNP position on nucleotide sequence | Alternative nucleic acid | Previously known SNP? |
|---|---|---|
| 114 | G –> | No |
| 151 | G –> C | Yes |
| 158 | C –> A | Yes |
| 179 | G –> A | Yes |
| 219 | A –> G | Yes |
| 243 | G –> | No |
| 253 | G –> A | Yes |
| 315 | A –> G | Yes |

TABLE 660-continued

Nucleic acid SNPs

| SNP position on nucleotide sequence | Alternative nucleic acid | Previously known SNP? |
|---|---|---|
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2146 | G -> A | Yes |
| 2224 | C -> T | No |
| 2362 | C -> T | Yes |
| 2513 | A -> G | No |
| 2656 | C -> T | Yes |

Variant protein M78076_PEA_1_P4 (SEQ ID NO:1351) according to the present invention has an amino acid sequence as given at the end of the application; it is encoded by transcript(s) M78076_PEA_1_T3 (SEQ ID NO:75). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P4 (SEQ ID NO:1351) and APP1_HUMAN (SEQ ID NO:1439):

1. An isolated chimeric polypeptide encoding for M78076_PEA_1_P4 (SEQ ID NO:1351), comprising a first amino acid sequence being at least 90% homologous to MGPASPAARGLSRRPGQPPLPLLLPLLLLLLPAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCP PPGTPDPSGTAVGDPSTRSWPPGSRVEGAEDEEEEESFPQPVDDYFVEPPQAEEEEETVPPPSSHTLAVVGK VTPTPRPTDGVDIYFGMPGEISEHEGFLRAKMDLEERRMRQINEVMREWAMADNQSKNLPKADRQALNE HFQSILQTLEEQVSGERQRLVETHATRVIALINDQRRAALEGFLAALQADPPQAERVLLALRRYLRAEQKE QRHTLRHYQHVAAVDPEKAQQMRFQVHTHLQVIEERVNQSLGLLDQNPHLAQELRPQIQELLHSEHLGPS ELEAPAPGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P4 (SEQ ID NO:1351), and a second amino acid sequence being at least 70%, optionally at least 80%, preferably at least 85%, more preferably at least 90% and most preferably at least 95% homologous to a polypeptide having the sequence ECLTVNPSLQIPLNP (SEQ ID NO:1718) corresponding to amino acids 527-541 of M78076_PEA_1_P4 (SEQ ID NO:1351), wherein said first amino acid sequence and second amino acid sequence are contiguous and in a sequential order.

2. An isolated polypeptide encoding for a tail of M78076_PEA_1_P4 (SEQ ID NO:1351), comprising a polypeptide being at least 70%, optionally at least about 80%, preferably at least about 85%, more preferably at least about 90% and most preferably at least about 95% homologous to the sequence ECLTVNPSLQIPLNP (SEQ ID NO: 1718) in M78076_PEA_1_P4 (SEQ ID NO:1351).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P4 (SEQ ID NO:1351) also has the following non-silent SNPs (Single Nucleotide Polymorphisms) as listed in Table 661, (given according to their position(s) on the amino acid sequence, with the alternative amino acid(s) listed; the last column indicates whether the SNP is known or not; the presence of known SNPs in variant protein M78076_PEA_1_P4 (SEQ ID NO:1351) sequence provides support for the deduced sequence of this variant protein according to the present invention).

TABLE 661

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P4 (SEQ ID NO:1351), as compared to the known protein Amyloid-like protein 1 precursor (SEQ ID NO:1439), are described in Table 662 (given according to their position(s) on the amino acid sequence in the first column; the second column indicates whether the glycosylation site is present in the variant protein; and the last column indicates whether the position is different on the variant protein).

TABLE 662

Glycosylation site(s)

| Position(s) on known amino acid sequence | Present in variant protein? | Position in variant protein? |
|---|---|---|
| 337 | yes | 337 |
| 461 | yes | 461 |
| 551 | no | |

Variant protein M78076_PEA_1_P4 (SEQ ID NO:1351) is encoded by the following transcript(s): M78076_PEA_

1_T3 (SEQ ID NO:75), for which the sequence(s) is/are given at the end of the application. The coding portion of transcript M78076_PEA_1_T3 (SEQ ID NO:75) is shown in bold; this coding portion starts at position 142 and ends at position 1764. The transcript also has the following SNPs as listed in Table 663 (given according to their position on the nucleotide sequence, with the alternative nucleic acid listed; the last column indicates whether the SNP is known or not; the presence of known SNPs in variant protein M78076_PEA_1_P4 (SEQ ID NO:1351) sequence provides support for the deduced sequence of this variant protein according to the present invention).

TABLE 663

Nucleic acid SNPs

| SNP position on nucleotide sequence | Alternative nucleic acid | Previously known SNP? |
|---|---|---|
| 114 | G –> | No |
| 151 | G –> C | Yes |
| 158 | C –> A | Yes |
| 179 | G –> A | Yes |
| 219 | A –> G | Yes |
| 243 | G –> | No |
| 253 | G –> A | Yes |
| 315 | A –> G | Yes |
| 366 | A –> G | Yes |
| 404 | C –> G | Yes |
| 512 | G –> A | Yes |
| 522 | C –> | No |
| 522 | C –> T | No |
| 575 | T –> C | No |
| 781 | G –> | No |
| 781 | G –> A | No |
| 927 | G –> | No |
| 951 | C –> | No |
| 1067 | G –> A | Yes |
| 1077 | G –> A | Yes |
| 1251 | G –> | No |
| 1398 | G –> T | Yes |
| 1423 | C –> T | Yes |
| 1817 | G –> A | Yes |
| 2362 | G –> A | Yes |
| 2440 | C –> T | No |
| 2578 | C –> T | Yes |
| 2729 | A –> G | No |
| 2872 | C –> T | Yes |

Variant protein M78076_PEA_1_P12 (SEQ ID NO:1352) according to the present invention has an amino acid sequence as given at the end of the application; it is encoded by transcript(s) M78076_PEA_1_T13 (SEQ ID NO:77). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P12 (SEQ ID NO:1352) and APP1_HUMAN (SEQ ID NO:1439):

1. An isolated chimeric polypeptide encoding for M78076_PEA_1_P12 (SEQ ID NO:1352), comprising a first amino acid sequence being at least 90% homologous to MGPASPAARGLSRRPGQPPLPLLL-PLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTDGV-DIYFGMPGEISEHEGFLRAKMDLEERRMRQINEVMR-EWAMADNQSKNLPKADRQALNE HFQSILQTLE-EQVSGERQRLVETHATRVIALINDQRRAALEGFLA-ALQADPPQAERVLLALRRYLRAEQKE QRHTLRHYQ-HVAAVDPEKAQQMRFQVHTHLQVIEERVNQSLG-LLDQNPHLAQELRPQIQELLHSEHLGPS ELEAPA-PGGSSEDKGGLQPPDSKDDTPMTLPKG corresponding to amino acids 1-526 of APP1_HUMAN (SEQ ID NO:1439), which also corresponds to amino acids 1-526 of M78076_PEA_1_P12 (SEQ ID NO:1352), and a second amino acid sequence being at least 70%, optionally at least 80%, preferably at least 85%, more preferably at least 90% and most preferably at least 95% homologous to a polypeptide having the sequence ECVCSKGFPFPLIGDSEG (SEQ ID NO: 1719) corresponding to amino acids 527-544 of M78076_PEA_1_P12 (SEQ ID NO:1352), wherein said first amino acid sequence and second amino acid sequence are contiguous and in a sequential order.

2. An isolated polypeptide encoding for a tail of M78076_PEA_1_P12 (SEQ ID NO:1352), comprising a polypeptide being at least 70%, optionally at least about 80%, preferably at least about 85%, more preferably at least about 90% and most preferably at least about 95% homologous to the sequence ECVCSKGFPFPLIGDSEG (SEQ ID NO:1719) in M78076_PEA_1_P12 (SEQ ID NO:1352).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P12 (SEQ ID NO:1352) also has the following non-silent SNPs (Single Nucleotide Polymorphisms) as listed in Table 664, (given according to their position(s) on the amino acid sequence, with the alternative amino acid(s) listed; the last column indicates whether the SNP is known or not; the presence of known SNPs in variant protein M78076_PEA_1_P12 (SEQ ID NO:1352) sequence provides support for the deduced sequence of this variant protein according to the present invention).

TABLE 664

Amino acid mutations

| SNP position(s) on amino acid sequence | Alternative amino acid(s) | Previously known SNP? |
|---|---|---|
| 4 | A –> P | Yes |
| 6 | P –> H | Yes |
| 13 | R –> H | Yes |
| 34 | Q –> | No |
| 38 | G –> R | Yes |
| 88 | P –> R | Yes |
| 124 | R –> Q | Yes |
| 127 | S –> | No |
| 145 | F –> S | No |
| 214 | G –> R | No |
| 214 | G –> | No |
| 262 | Q –> | No |
| 270 | V –> | No |
| 309 | G –> E | Yes |
| 370 | Q –> | No |

The glycosylation sites of variant protein M78076_PEA_1_P12 (SEQ ID NO:1352), as compared to the known protein Amyloid-like protein 1 precursor (SEQ ID NO:1439), are described in Table 665 (given according to their position(s) on the amino acid sequence in the first column; the second column indicates whether the glycosylation site is present in the variant protein; and the last column indicates whether the position is different on the variant protein).

TABLE 665

| | Glycosylation site(s) | |
|---|---|---|
| Position(s) on known amino acid sequence | Present in variant protein? | Position in variant protein? |
| 337 | yes | 337 |
| 461 | yes | 461 |
| 551 | no | |

Variant protein M78076_PEA_1_P12 (SEQ ID NO:1352) is encoded by the following transcript(s): M78076_PEA_1_T13 (SEQ ID NO:77), for which the sequence(s) is/are given at the end of the application. The coding portion of transcript M78076_PEA_1_T13 (SEQ ID NO:77) is shown in bold; this coding portion starts at position 142 and ends at position 1773. The transcript also has the following SNPs as listed in Table 666 (given according to their position on the nucleotide sequence, with the alternative nucleic acid listed; the last column indicates whether the SNP is known or not; the presence of known SNPs in variant protein M78076_PEA_1_P12 (SEQ ID NO:1352) sequence provides support for the deduced sequence of this variant protein according to the present invention).

TABLE 666

| | Nucleic acid SNPs | |
|---|---|---|
| SNP position on nucleotide sequence | Alternative nucleic acid | Previously known SNP? |
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1816 | G -> A | Yes |
| 1894 | C -> T | No |
| 2032 | C -> T | Yes |
| 2183 | A -> G | No |
| 2326 | C -> T | Yes |

Variant protein M78076_PEA_1_P14 (SEQ ID NO:1353) according to the present invention has an amino acid sequence as given at the end of the application; it is encoded by transcript(s) M78076_PEA_1_T15 (SEQ ID NO:78). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P14 (SEQ ID NO:1353) and APP1_HUMAN (SEQ ID NO:1439):

1. An isolated chimeric polypeptide encoding for M78076_PEA_1_P14 (SEQ ID NO:1353), comprising a first amino acid sequence being at least 90% homologous to MGPASPAARGLSRRPGQPPLPLLLPLLLLLLRAQP-AIGSLAGGSPGAAEAPGSAQVAGLCGRLTLHRDLRT GRWEPDPQRSRRCLRDPQRVLEYCRQMYPELQI-ARVEQATQAIPMERWCGGSRSGSCAHPHHQVVPFRC LPGEFVSEALLVPEGCRFLHQERMDQCESSTRRHQE-AQEACSSQGLILHGSGMLLPCGSDRFRGVEYVCCP PPGTPDPSGTAVGDPSTRSWPPGSRVEGAEDEEEEE-SFPQPVDDYFVEPPQAEEEEETVPPPSSHTLAVVGK VTPTPRPTDGVDIYFGMPGEISEHEGFL-RAKMDLEERRMRQINEVMREWAMADN-QSKNLPKADRQALNE HFQSILQTLEEQVSGERQRL-VETHATRVIALINDQRRAALEGFLAALQADPPQAER-VLLALRRYLRAEQKE QRHTLRHYQHVAAVDPE-KAQQMRFQVHTHLQVIEERVNQSLGLL-DQNPHLAQELRPQIQELLHSEHLGPS ELEAPA-PGGSSEDKGGLQPPDSKDDTPMTLPKGSTEQDAASP-EKEKMNPLEQYERKVNASVPRGFPFHSSE IQRDEL corresponding to amino acids 1-570 of APP1_HUMAN (SEQ ID NO:1439), which also corresponds to amino acids 1-570 of M78076_PEA_1P14 (SEQ ID NO:1353), and a second amino acid sequence being at least 70%, optionally at least 80%, preferably at least 85%, more preferably at least 90% and most preferably at least 95% homologous to a polypeptide having the sequence VRGGTAGYL-GEETRGQRPGCDSQSHTGPSKKP-SAPSPLPAGTSWDRGVP (SEQ ID NO:1720) corresponding to amino acids 571-619 of M78076_PEA_1_P14 (SEQ ID NO:1353), wherein said first amino acid sequence and second amino acid sequence are contiguous and in a sequential order.

2. An isolated polypeptide encoding for a tail of M78076_PEA_1_P14 (SEQ ID NO:1353), comprising a polypeptide being at least 70%, optionally at least about 80%, preferably at least about 85%, more preferably at least about 90% and most preferably at least about 95% homologous to the sequence VRGGTAGYLGEETRGQRPGCDSQSHT-GPSKKPSAPSPLPAGTSWDRGVP (SEQ ID NO: 1720) in M78076_PEA_1_P14 (SEQ ID NO:1353).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P14 (SEQ ID NO:1353) also has the following non-silent SNPs (Single Nucleotide Polymorphisms) as listed in Table 667, (given according to their position(s) on the amino acid sequence, with the alternative amino acid(s) listed; the last column indicates whether the SNP is known or not; the presence of known SNPs in variant protein M78076_PEA_1_P14 (SEQ ID NO:1353) sequence provides support for the deduced sequence of this variant protein according to the present invention).

TABLE 667

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P14 (SEQ ID NO:1353), as compared to the known protein Amyloid-like protein 1 precursor (SEQ ID NO:1439), are described in Table 668 (given according to their position(s) on the amino acid sequence in the first column; the second column indicates whether the glycosylation site is present in the variant protein; and the last column indicates whether the position is different on the variant protein).

TABLE 668

Glycosylation site(s)

| Position(s) on known amino acid sequence | Present in variant protein? | Position in variant protein? |
|---|---|---|
| 337 | yes | 337 |
| 461 | yes | 461 |
| 551 | yes | 551 |

Variant protein M78076_PEA_1_P14 (SEQ ID NO:1353) is encoded by the following transcript(s): M78076_PEA_1_T15 (SEQ ID NO:78), for which the sequence(s) is/are given at the end of the application. The coding portion of transcript M78076_PEA_1_T15 (SEQ ID NO:78) is shown in bold; this coding portion starts at position 142 and ends at position 1998. The transcript also has the following SNPs as listed in Table 669 (given according to their position on the nucleotide sequence, with the alternative nucleic acid listed; the last column indicates whether the SNP is known or not; the presence of known SNPs in variant protein M78076_PEA_1_P14 (SEQ ID NO:1353) sequence provides support for the deduced sequence of this variant protein according to the present invention).

TABLE 669

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |

TABLE 669-continued

Nucleic acid SNPs

| SNP position on nucleotide sequence | Alternative nucleic acid | Previously known SNP? |
|---|---|---|
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2008 | G -> A | Yes |
| 2086 | C -> T | No |
| 2224 | C -> T | Yes |
| 2375 | A -> G | No |
| 2518 | C -> T | Yes |

Variant protein M78076_PEA_1_P21 (SEQ ID NO:1354) according to the present invention has an amino acid sequence as given at the end of the application; it is encoded by transcript(s) M78076_PEA_1_T23 (SEQ ID NO:79). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P21 (SEQ ID NO:1354) and APP1_HUMAN (SEQ ID NO:1439):

1. An isolated chimeric polypeptide encoding for M78076_PEA_1_P21 (SEQ ID NO:1354), comprising a first amino acid sequence being at least 90% homologous to MGPASPAARGLSRRPGQPPLPLLL-PLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTDG-VDIYFGMPGEISEHEGFLRAKMDLEERRMRQINEV-MREWAMADNQSKNLPKADRQALNE corresponding to amino acids 1-352 of APP1_HUMAN (SEQ ID NO:1439), which also corresponds to amino acids 1-352 of M78076_PEA_1_P21 (SEQ ID NO:1354), and a second amino acid sequence being at least 90% homologous to AERVLLALRRYLRAEQKEQRHTLRHYQH-VAAVDPEKAQQMRFQVHTHLQVIEERVN-QSLGLLDQNPHL AQELRPQIQELLHSEHLGPSELEA-PAPGGSSEDKGGLQPPDSKDDTPMTLPKGSTEQDAA-SPEKEKMNPLE QYERKVNASVPRGFPFHSSEIQRDE-LAPAGTGVSREAVSGLLIMGAGGGSLIV-LSMLLLRRKKPYGAISHG VVEVDPMLTLEEQQL-RELQRHGYENPTYRFLEERP corresponding to amino acids 406-650 of APP1_HUMAN (SEQ ID NO:1439), which also corresponds to amino acids 353-597 of M78076_PEA_1_P21 (SEQ ID NO:1354), wherein said first amino acid sequence and second amino acid sequence are contiguous and in a sequential order.

2. An isolated chimeric polypeptide encoding for an edge portion of M78076_PEA_1_P21 (SEQ ID NO:1354), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EA, having a structure as follows: a sequence starting from any of amino acid numbers 352-x to 352; and ending at any of amino acid numbers 353+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA_1_P21 (SEQ ID NO:1354) also has the following non-silent SNPs (Single Nucleotide Polymorphisms) as listed in Table 670, (given according to their position(s) on the amino acid sequence, with the alternative amino acid(s) listed; the last column indicates whether the SNP is known or not; the presence of known SNPs in variant protein M78076_PEA_1_P21 (SEQ ID NO:1354) sequence provides support for the deduced sequence of this variant protein according to the present invention).

TABLE 670

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |

The glycosylation sites of variant protein M78076_PEA_1_P21 (SEQ ID NO:1354), as compared to the known protein Amyloid-like protein 1 precursor (SEQ ID NO:1439), are described in Table 671 (given according to their position(s) on the amino acid sequence in the first column; the second column indicates whether the glycosylation site is present in the variant protein; and the last column indicates whether the position is different on the variant protein).

TABLE 671

Glycosylation site(s)

| Position(s) on known amino acid sequence | Present in variant protein? | Position in variant protein? |
|---|---|---|
| 337 | yes | 337 |
| 461 | yes | 408 |
| 551 | yes | 498 |

Variant protein M78076_PEA_1_P21 (SEQ ID NO:1354) is encoded by the following transcript(s): M78076_PEA_1_T23 (SEQ ID NO:79), for which the sequence(s) is/are given at the end of the application. The coding portion of transcript M78076_PEA_1_T23 (SEQ ID NO:79) is shown in bold; this coding portion starts at position 142 and ends at position 1932. The transcript also has the following SNPs as listed in Table 672 (given according to their position on the nucleotide sequence, with the alternative nucleic acid listed; the last column indicates whether the SNP is known or not; the presence of known SNPs in variant protein M78076_PEA_1_P21 (SEQ ID NO:1354) sequence provides support for the deduced sequence of this variant protein according to the present invention).

TABLE 672

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1239 | G -> T | Yes |
| 1264 | C -> T | Yes |
| 1728 | G -> A | Yes |
| 1806 | C -> T | No |
| 1944 | C -> T | Yes |
| 2095 | A -> G | No |
| 2238 | C -> T | Yes |

Variant protein M78076_PEA_1_P24 (SEQ ID NO:1355) according to the present invention has an amino acid sequence as given at the end of the application; it is encoded by transcript(s) M78076_PEA_1_T26 (SEQ ID NO:80). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P24 (SEQ ID NO:1355) and APP1_HUMAN (SEQ ID NO:1439):

1. An isolated chimeric polypeptide encoding for M78076_PEA_1_P24 (SEQ ID NO:1355), comprising a first amino acid sequence being at least 90% homologous to MGPASPAARGLSRRPGQPPLPLLLPLLLLLLRAQPAI-GSLAGGSPGAAEAPGSAQVAGLCGRLTLHRDLRT GRWEPDPQRSRRCLRDPQRVLEYCRQMYPELQI-ARVEQATQAIPMERWCGGSRSGSCAHPHHQVVPFRC LPGEFVSEALLVPEGCRFLHQERM-DQCESSTRRHQEAQEACSSQGLILHGSG-MLLPCGSDRFRGVEYVCCP PPGTPDPSGTAVGDP-STRSWPPGSRVEGAEDEEEEESFPQPVDDYFVEPPQA-EEEEETVPPPSSHTLAVVGK VTPTPRPTDGVDIYFG-MPGEISEHEGFLRAKMDLEERRMR-QINEVMREWAMADNQSKNLPKADRQALNE HFQSILQTLEEQVSGERQRLVETHA-TRVIALINDQRRAALEGFLAALQADP-PQAERVLLALRRYLRAEQKE QRHTLRHYQHVAAVD-PEKAQQMRFQVHTHLQVIEERVNQSLGLLDQNPHLA-QELRPQI corresponding to amino acids 1-481 of APP1_HUMAN (SEQ ID NO:1439), which also corresponds to amino acids 1-481 of M78076_PEA_1_P24 (SEQ ID NO:1355), and a second amino acid sequence being at least 70%, optionally at least 80%, preferably at least 85%, more preferably at least 90% and most preferably at least 95% homologous to a polypeptide having the sequence RECLLPWLPLQISEGRS (SEQ ID NO:1721) corresponding to amino acids 482-498 of M78076_PEA_1_P24 (SEQ ID NO:1355), wherein said first amino acid sequence and second amino acid sequence are contiguous and in a sequential order.

2. An isolated polypeptide encoding for a tail of M78076_PEA_1_P24 (SEQ ID NO:1355), comprising a polypeptide being at least 70%, optionally at least about 80%, preferably at least about 85%, more preferably at least about 90% and most preferably at least about 95% homologous to the sequence RECLLPWLPLQISEGRS (SEQ ID NO: 1721) in M78076_PEA_1_P24 (SEQ ID NO:1355).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P24 (SEQ ID NO:1355) also has the following non-silent SNPs (Single Nucleotide Polymorphisms) as listed in Table 673, (given according to their position(s) on the amino acid sequence, with the alternative amino acid(s) listed; the last column indicates whether the SNP is known or not; the presence of known SNPs in variant protein M78076_PEA_1_P24 (SEQ ID NO:1355) sequence provides support for the deduced sequence of this variant protein according to the present invention).

TABLE 673

Amino acid mutations

| SNP position(s) on amino acid sequence | Alternative amino acid(s) | Previously known SNP? |
|---|---|---|
| 4 | A -> P | Yes |
| 6 | P -> H | Yes |

TABLE 673-continued

Amino acid mutations

| SNP position(s) on amino acid sequence | Alternative amino acid(s) | Previously known SNP? |
|---|---|---|
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P24 (SEQ ID NO:1355), as compared to the known protein Amyloid-like protein 1 precursor (SEQ ID NO:1439), are described in Table 674 (given according to their position(s) on the amino acid sequence in the first column; the second column indicates whether the glycosylation site is present in the variant protein; and the last column indicates whether the position is different on the variant protein).

TABLE 674

Glycosylation site(s)

| Position(s) on known amino acid sequence | Present in variant protein? | Position in variant protein? |
|---|---|---|
| 337 | yes | 337 |
| 461 | yes | 461 |
| 551 | no | |

Variant protein M78076_PEA_1_P24 (SEQ ID NO:1355) is encoded by the following transcript(s): M78076_PEA_1_T26 (SEQ ID NO:80), for which the sequence(s) is/are given at the end of the application. The coding portion of transcript M78076_PEA_1_T26 (SEQ ID NO:80) is shown in bold; this coding portion starts at position 142 and ends at position 1635. The transcript also has the following SNPs as listed in Table 675 (given according to their position on the nucleotide sequence, with the alternative nucleic acid listed; the last column indicates whether the SNP is known or not; the presence of known SNPs in variant protein M78076_PEA_1_P24 (SEQ ID NO:1355) sequence provides support for the deduced sequence of this variant protein according to the present invention).

TABLE 675

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |

TABLE 675-continued

Nucleic acid SNPs

| SNP position on nucleotide sequence | Alternative nucleic acid | Previously known SNP? |
|---|---|---|
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 2184 | G -> A | Yes |

Variant protein M78076_PEA_1_P2 (SEQ ID NO:1356) according to the present invention has an amino acid sequence as given at the end of the application; it is encoded by transcript(s) M78076_PEA_1_T27 (SEQ ID NO:81). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P2 (SEQ ID NO:1356) and APP1_HUMAN (SEQ ID NO:1439):

1. An isolated chimeric polypeptide encoding for M78076_PEA_1_P2 (SEQ ID NO:1356), comprising a first amino acid sequence being at least 90% homologous to MGPASPAARGLSRRPGQPPLPLLL-PLLLLLLRAQPAIGSLAGGSPGAAEAPG-SAQVAGLCGRLTLHRDLRT GRWEPDPQRSRRCLRD-PQRVLEYCRQMYPELQIARVEQATQAIPMERWCGGS-RSGSCAHPHHQVVPFRC LPGEFVSEALLVPEGCRFL-HQERMDQCESSTRRHQEAQEACSSQG-LILHGSGMLLPCGSDRFRGVEYVCCP PPGTPDPSG-TAVGDPSTRSWPPGSRVEGAEDEEEEESFPQPVDDYF-VEPPQAEEEEETVPPPSSHTLAVVGK VTPTPRPTDG-VDIYFGMPGEISEHEGFLRAKMDLEERRMRQINE-VMREWAMADNQSKNLPKADRQALNE HFQSILQTLEEQVSGERQRLVETHATRVIALINDQ-RRAALEGFLAALQADPPQAERVLLALRRYLRAEQKE QRHTLRHYQHVAAVDPEKAQQMRFQV corresponding to amino acids 1-449 of APP1_HUMAN (SEQ ID NO:1439), which also corresponds to amino acids 1-449 of M78076_PEA_1_P2 (SEQ ID NO:1356), and a second amino acid sequence being at least 70%, optionally at least 80%, preferably at least 85%, more preferably at least 90% and most preferably at least 95% homologous to a polypeptide having the sequence LTSFQLPNAPLFLRRPRLRLF-SCPLDPLSVSWTPSYPLNTASLPLPSL-SAQLPDPETWTLTCCVFDPCFLALG FLLPPPSILCSVPWIFTAFPRIVFFFFF-FLRQVLALSPRQESSVRSWLIATSTSWVQAILLPQPLE (SEQ ID NO: 1722) corresponding to amino acids 450-588 of M78076_PEA_1_P2 (SEQ ID NO:1356), wherein said first amino acid sequence and second amino acid sequence are contiguous and in a sequential order.

2. An isolated polypeptide encoding for a tail of M78076_PEA_1_P2 (SEQ ID NO:1356), comprising a polypeptide being at least 70%, optionally at least about 80%, preferably at least about 85%, more preferably at least about 90% and most preferably at least about 95% homologous to the sequence LTSFQLPNAPLFLRRPRLRLFSCPLD-PLSVSWTPSYPLNTASLPLPSLSAQLPD-PETWTLTCCVFDPCFLALG FLLPPPSILCSVPWIFT-AFPRIVFFFFFLRQVLALSPRQESSVRSWLIATSTSW-VQAILLPQPLE (SEQ ID NO: 1722) in M78076_PEA_1_P2 (SEQ ID NO:1356).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein M78076_PEA_1_P2 (SEQ ID NO:1356) also has the following non-silent SNPs (Single Nucleotide Polymorphisms) as listed in Table 676, (given according to their position(s) on the amino acid sequence, with the alternative amino acid(s) listed; the last column indicates whether the SNP is known or not; the presence of known SNPs in variant protein M78076_PEA_1_P2 (SEQ ID NO:1356) sequence provides support for the deduced sequence of this variant protein according to the present invention).

TABLE 676

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |
| 520 | A -> S | Yes |
| 546 | F -> | Yes |
| 564 | S -> C | Yes |

The glycosylation sites of variant protein M78076_PEA_1_P2 (SEQ ID NO:1356), as compared to the known protein Amyloid-like protein 1 precursor (SEQ ID NO:1439), are described in Table 677 (given according to their position(s) on the amino acid sequence in the first column; the second column indicates whether the glycosylation site is present in the variant protein; and the last column indicates whether the position is different on the variant protein).

TABLE 677

Glycosylation site(s)

| Position(s) on known amino acid sequence | Present in variant protein? | Position in variant protein? |
|---|---|---|
| 337 | yes | 337 |
| 461 | no | |
| 551 | no | |

Variant protein M78076_PEA_1_P2 (SEQ ID NO:1356) is encoded by the following transcript(s): M78076_PEA_1_T27 (SEQ ID NO:81), for which the sequence(s) is/are given at the end of the application. The coding portion of transcript M78076_PEA_1_T27 (SEQ ID NO:81) is shown in bold; this coding portion starts at position 142 and ends at position 1905. The transcript also has the following SNPs as listed in Table 678 (given according to their position on the nucleotide sequence, with the alternative nucleic acid listed; the last column indicates whether the SNP is known or not; the presence of known SNPs in variant protein M78076_PEA_1_P2 (SEQ ID NO:1356) sequence provides support for the deduced sequence of this variant protein according to the present invention).

TABLE 678

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1500 | C -> T | Yes |
| 1699 | G -> T | Yes |
| 1725 | G -> A | Yes |
| 1777 | T -> | Yes |
| 1831 | A -> T | Yes |
| 2274 | A -> G | Yes |
| 2525 | A -> G | Yes |
| 2681 | G -> A | Yes |
| 3831 | G -> A | Yes |

Variant protein M78076_PEA_1_P25 (SEQ ID NO:1357) according to the present invention has an amino acid sequence as given at the end of the application; it is encoded by transcript(s) M78076_PEA_1_T28 (SEQ ID NO:82). An alignment is given to the known protein (Amyloid-like protein 1 precursor (SEQ ID NO:1439)) at the end of the application. One or more alignments to one or more previously published protein sequences are given at the end of the application. A brief description of the relationship of the variant protein according to the present invention to each such aligned protein is as follows:

Comparison report between M78076_PEA_1_P25 (SEQ ID NO:1357) and APP1_HUMAN (SEQ ID NO:1439):

1. An isolated chimeric polypeptide encoding for M78076_PEA_1_P25 (SEQ ID NO:1357), comprising a first amino acid sequence being at least 90% homologous to MGPASPAARGLSRRPGQPPLPLLLPLLLLLLRAQPA-IGSLAGGSPGAAEAPGSAQVAGLCGRLTLHRDLRT GRWEPDPQRSRRCLRDPQRVLEYCRQMYPELQIA-RVEQATQAIPMERWCGGSRSGSCAHPHHQVVPFRC LPGEFVSEALLVPEGCRFLHQERMDQCESSTRRHQ-EAQEACSSQGLILHGSGMLLPCGSDRFRGVEYVCCP PPGTPDPSGTAVGDPSTRSWPPGSRVEGAEDEEEES-FPQPVDDYFVEPPQAEEEEETVPPPSSHTLAVVGK VTPTPRPTDGVDIYFGMPGEISEHEGFLRAKMD-LEERRMRQINEVMREWAMADNQSKNLPKADRQAL-NE HFQSILQTLEEQVSGERQRLVETHATRVIALI-NDQRRAALEGFLAALQADPPQAERVLLALRRYLRA-EQKE QRHTLRHYQHVAAVDPEKAQQMRFQ corresponding to amino acids 1-448 of APP1_HUMAN (SEQ ID NO:1439), which also corresponds to amino acids 1-448 of M78076_PEA_1_P25 (SEQ ID NO:1357), and a second amino acid sequence being at least 70%, optionally at least 80%, preferably at least 85%, more preferably at least 90% and most preferably at least 95% homologous to a polypeptide having the sequence PQNPNSQPRAAGSLEVIISH-PFVRRLEILISPFQFQNSIPKNSQIVPAASPRGTSSP (SEQ ID NO:1723) corresponding to amino acids 449-505 of M78076_PEA_1_P25 (SEQ ID NO:1357), wherein said first amino acid sequence and second amino acid sequence are contiguous and in a sequential order.

2. An isolated polypeptide encoding for a tail of M78076_PEA_1_P25 (SEQ ID NO:1357), comprising a polypeptide being at least 70%, optionally at least about 80%, preferably at least about 85%, more preferably at least about 90% and most preferably at least about 95% homologous to the sequence PQNPNSQPRAAGSLEVIISHPFVRRLEI-LISPFQFQNSIPKNSQIVPAASPRGTSSP (SEQ ID NO:1723) in M78076_PEA_1_P25 (SEQ ID NO:1357).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein M78076_PEA_1_P25 (SEQ ID NO:1357) also has the following non-silent SNPs (Single Nucleotide Polymorphisms) as listed in Table 679, (given according to their position(s) on the amino acid sequence, with the alternative amino acid(s) listed; the last column indicates whether the SNP is known or not; the presence of known SNPs in variant protein M78076_PEA_1_P25 (SEQ ID NO:1357) sequence provides support for the deduced sequence of this variant protein according to the present invention).

TABLE 679

Amino acid mutations

| SNP position(s) on amino acid sequence | Alternative amino acid(s) | Previously known SNP? |
|---|---|---|
| 4 | A -> P | Yes |
| 6 | P -> H | Yes |
| 13 | R -> H | Yes |
| 34 | Q -> | No |
| 38 | G -> R | Yes |
| 88 | P -> R | Yes |
| 124 | R -> Q | Yes |
| 127 | S -> | No |
| 145 | F -> S | No |
| 214 | G -> R | No |
| 214 | G -> | No |
| 262 | Q -> | No |
| 270 | V -> | No |
| 309 | G -> E | Yes |
| 370 | Q -> | No |

The glycosylation sites of variant protein M78076_PEA_1_P25 (SEQ ID NO:1357), as compared to the known protein Amyloid-like protein 1 precursor (SEQ ID NO:1439), are described in Table 680 (given according to their position(s) on the amino acid sequence in the first column; the second column indicates whether the glycosylation site is present in the variant protein; and the last column indicates whether the position is different on the variant protein).

TABLE 680

Glycosylation site(s)

| Position(s) on known amino acid sequence | Present in variant protein? | Position in variant protein? |
|---|---|---|
| 337 | yes | 337 |
| 461 | no | |
| 551 | no | |

Variant protein M78076_PEA_1_P25 (SEQ ID NO:1357) is encoded by the following transcript(s): M78076_PEA_1_T28 (SEQ ID NO:82), for which the sequence(s) is/are given at the end of the application. The coding portion of transcript M78076_PEA_1_T28 (SEQ ID NO:82) is shown in bold; this coding portion starts at position 142 and ends at position 1656. The transcript also has the following SNPs as listed in Table 681 (given according to their position on the nucleotide sequence, with the alternative nucleic acid listed; the last column indicates whether the SNP is known or not; the presence of known SNPs in variant protein M78076_PEA_1_P25 (SEQ ID NO:1357) sequence provides support for the deduced sequence of this variant protein according to the present invention).

TABLE 681

Nucleic acid SNPs

| SNP position on nucleotide sequence | Alternative nucleic acid | Previously known SNP? |
|---|---|---|
| 114 | G -> | No |
| 151 | G -> C | Yes |
| 158 | C -> A | Yes |
| 179 | G -> A | Yes |
| 219 | A -> G | Yes |
| 243 | G -> | No |
| 253 | G -> A | Yes |
| 315 | A -> G | Yes |

TABLE 681-continued

Nucleic acid SNPs

| SNP position on nucleotide sequence | Alternative nucleic acid | Previously known SNP? |
|---|---|---|
| 366 | A -> G | Yes |
| 404 | C -> G | Yes |
| 512 | G -> A | Yes |
| 522 | C -> | No |
| 522 | C -> T | No |
| 575 | T -> C | No |
| 781 | G -> | No |
| 781 | G -> A | No |
| 927 | G -> | No |
| 951 | C -> | No |
| 1067 | G -> A | Yes |
| 1077 | G -> A | Yes |
| 1251 | G -> | No |
| 1398 | G -> T | Yes |
| 1423 | C -> T | Yes |
| 1593 | A -> G | No |
| 1736 | C -> T | Yes |

As noted above, cluster M78076 features 35 segment(s), which were listed in Table 655 above and for which the sequence(s) are given at the end of the application. These segment(s) are portions of nucleic acid sequence(s) which are described herein separately because they are of particular interest. A description of each segment according to the present invention is now provided.

Segment cluster M78076_PEA_1_node_0 (SEQ ID NO:659) according to the present invention is supported by 47 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 682 below describes the starting and ending position of this segment on each transcript.

TABLE 682

Segment location on transcripts

| Transcript name | Segment starting position | Segment ending position |
|---|---|---|
| M78076_PEA_1_T2 (SEQ ID NO:74) | 1 | 160 |
| M78076_PEA_1_T3 (SEQ ID NO:75) | 1 | 160 |
| M78076_PEA_1_T5 (SEQ ID NO:76) | 1 | 160 |
| M78076_PEA_1_T13 (SEQ ID NO:77) | 1 | 160 |
| M78076_PEA_1_T15 (SEQ ID NO:78) | 1 | 160 |
| M78076_PEA_1_T23 (SEQ ID NO:79) | 1 | 160 |
| M78076_PEA_1_T26 (SEQ ID NO:80) | 1 | 160 |
| M78076_PEA_1_T27 (SEQ ID NO:81) | 1 | 160 |
| M78076_PEA_1_T28 (SEQ ID NO:82) | 1 | 160 |

Segment cluster M78076_PEA_1_node_10 (SEQ ID NO:660) according to the present invention is supported by 70 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_

1_T26 (SEQ ID NO:80), M78076_PEA_1_T27 (SEQ ID NO:81) and M78076_PEA_1_T28 (SEQ ID NO:82). Table 683 below describes the starting and ending position of this segment on each transcript.

TABLE 683

Segment location on transcripts

| Transcript name | Segment starting position | Segment ending position |
|---|---|---|
| M78076_PEA_1_T2 (SEQ ID NO:74) | 433 | 565 |
| M78076_PEA_1_T3 (SEQ ID NO:75) | 433 | 565 |
| M78076_PEA_1_T5 (SEQ ID NO:76) | 433 | 565 |
| M78076_PEA_1_T13 (SEQ ID NO:77) | 433 | 565 |
| M78076_PEA_1_T15 (SEQ ID NO:78) | 433 | 565 |
| M78076_PEA_1_T23 (SEQ ID NO:79) | 433 | 565 |
| M78076_PEA_1_T26 (SEQ ID NO:80) | 433 | 565 |
| M78076_PEA_1_T27 (SEQ ID NO:81) | 433 | 565 |
| M78076_PEA_1_T28 (SEQ ID NO:82) | 433 | 565 |

Segment cluster M78076_PEA_1_node_15 (SEQ ID NO:661) according to the present invention is supported by 74 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 684 below describes the starting and ending position of this segment on each transcript.

TABLE 684

Segment location on transcripts

| Transcript name | Segment starting position | Segment ending position |
|---|---|---|
| M78076_PEA_1_T2 (SEQ ID NO:74) | 679 | 812 |
| M78076_PEA_1_T3 (SEQ ID NO:75) | 679 | 812 |
| M78076_PEA_1_T5 (SEQ ID NO:76) | 679 | 812 |
| M78076_PEA_1_T13 (SEQ ID NO:77) | 679 | 812 |
| M78076_PEA_1_T15 (SEQ ID NO:78) | 679 | 812 |
| M78076_PEA_1_T23 (SEQ ID NO:79) | 679 | 812 |
| M78076_PEA_1_T26 (SEQ ID NO:80) | 679 | 812 |
| M78076_PEA_1_T27 (SEQ ID NO:81) | 679 | 812 |
| M78076_PEA_1_T28 (SEQ ID NO:82) | 679 | 812 |

Segment cluster M78076_PEA_1_node_18 (SEQ ID NO:662) according to the present invention is supported by 95 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 685 below describes the starting and ending position of this segment on each transcript.

TABLE 685

Segment location on transcripts

| Transcript name | Segment starting position | Segment ending position |
|---|---|---|
| M78076_PEA_1_T2 (SEQ ID NO:74) | 813 | 991 |
| M78076_PEA_1_T3 (SEQ ID NO:75) | 813 | 991 |
| M78076_PEA_1_T5 (SEQ ID NO:76) | 813 | 991 |
| M78076_PEA_1_T13 (SEQ ID NO:77) | 813 | 991 |
| M78076_PEA_1_T15 (SEQ ID NO:78) | 813 | 991 |
| M78076_PEA_1_T23 (SEQ ID NO:79) | 813 | 991 |
| M78076_PEA_1_T26 (SEQ ID NO:80) | 813 | 991 |
| M78076_PEA_1_T27 (SEQ ID NO:81) | 813 | 991 |
| M78076_PEA_1_T28 (SEQ ID NO:82) | 813 | 991 |

Segment cluster M78076_PEA_1_node_20 (SEQ ID NO:663) according to the present invention is supported by 99 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 686 below describes the starting and ending position of this segment on each transcript.

TABLE 686

Segment location on transcripts

| Transcript name | Segment starting position | Segment ending position |
|---|---|---|
| M78076_PEA_1_T2 (SEQ ID NO:74) | 992 | 1122 |
| M78076_PEA_1_T3 (SEQ ID NO:75) | 992 | 1122 |
| M78076_PEA_1_T5 (SEQ ID NO:76) | 992 | 1122 |
| M78076_PEA_1_T13 (SEQ ID NO:77) | 992 | 1122 |
| M78076_PEA_1_T15 (SEQ ID NO:78) | 992 | 1122 |
| M78076_PEA_1_T23 (SEQ ID NO:79) | 992 | 1122 |
| M78076_PEA_1_T26 (SEQ ID NO:80) | 992 | 1122 |
| M78076_PEA_1_T27 (SEQ ID NO:81) | 992 | 1122 |
| M78076_PEA_1_T28 (SEQ ID NO:82) | 992 | 1122 |

Segment cluster M78076_PEA_1_node_24 (SEQ ID NO:664) according to the present invention is supported by 105 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T26 (SEQ ID NO:80), M78076_PEA_1_T27 (SEQ ID NO:81) and M78076_PEA_1_T28 (SEQ ID NO:82). Table 687 below describes the starting and ending position of this segment on each transcript.

TABLE 687

Segment location on transcripts

| Transcript name | Segment starting position | Segment ending position |
|---|---|---|
| M78076_PEA_1_T2 (SEQ ID NO:74) | 1198 | 1356 |
| M78076_PEA_1_T3 (SEQ ID NO:75) | 1198 | 1356 |
| M78076_PEA_1_T5 (SEQ ID NO:76) | 1198 | 1356 |

TABLE 687-continued

Segment location on transcripts

| Transcript name | Segment starting position | Segment ending position |
| --- | --- | --- |
| M78076_PEA_1_T13 (SEQ ID NO:77) | 1198 | 1356 |
| M78076_PEA_1_T15 (SEQ ID NO:78) | 1198 | 1356 |
| M78076_PEA_1_T26 (SEQ ID NO:80) | 1198 | 1356 |
| M78076_PEA_1_T27 (SEQ ID NO:81) | 1198 | 1356 |
| M78076_PEA_1_T28 (SEQ ID NO:82) | 1198 | 1356 |

Segment cluster M78076_PEA_1_node_26 (SEQ ID NO:665) according to the present invention is supported by 99 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 688 below describes the starting and ending position of this segment on each transcript.

TABLE 688

Segment location on transcripts

| Transcript name | Segment starting position | Segment ending position |
| --- | --- | --- |
| M78076_PEA_1_T2 (SEQ ID NO:74) | 1357 | 1485 |
| M78076_PEA_1_T3 (SEQ ID NO:75) | 1357 | 1485 |
| M78076_PEA_1_T5 (SEQ ID NO:76) | 1357 | 1485 |
| M78076_PEA_1_T13 (SEQ ID NO:77) | 1357 | 1485 |
| M78076_PEA_1_T15 (SEQ ID NO:78) | 1357 | 1485 |
| M78076_PEA_1_T23 (SEQ ID NO:79) | 1198 | 1326 |
| M78076_PEA_1_T26 (SEQ ID NO:80) | 1357 | 1485 |
| M78076_PEA_1_T27 (SEQ ID NO:81) | 1357 | 1485 |
| M78076_PEA_1_T28 (SEQ ID NO:82) | 1357 | 1485 |

Segment cluster M78076_PEA_1_node_29 (SEQ ID NO:666) according to the present invention is supported by 2 libraries. The number of libraries was determined as previously described. This segment can be found in the following transcript(s): M78076_PEA_1_T27 (SEQ ID NO:81). Table 689 below describes the starting and ending position of this segment on each transcript.

TABLE 689

Segment location on transcripts

| Transcript name | Segment starting position | Segment ending position |
| --- | --- | --- |
| M78076_PEA_1_T27 (SEQ ID NO:81) | 1490 | 3132 |

Segment cluster M78076_PEA_1_node_32 (SEQ ID NO:667) according to the present invention is supported by 2 libraries. The number of libraries was determined as previously described. This segment can be found in the following transcript(s): M78076_PEA_1_T26 (SEQ ID NO:80) and M78076_PEA_1_T27 (SEQ ID NO:81). Table 690 below describes the starting and ending position of this segment on each transcript.

TABLE 690

Segment location on transcripts

| Transcript name | Segment starting position | Segment ending position |
| --- | --- | --- |
| M78076_PEA_1_T26 (SEQ ID NO:80) | 1586 | 2457 |
| M78076_PEA_1_T27 (SEQ ID NO:81) | 3233 | 4104 |

Segment cluster M78076_PEA_1_node_35 (SEQ ID NO:668) according to the present invention is supported by 4 libraries. The number of libraries was determined as previously described. This segment can be found in the following transcript(s): M78076_PEA_1_T2 (SEQ ID NO:74) and M78076_PEA_1_T5 (SEQ ID NO:76). Table 691 below describes the starting and ending position of this segment on each transcript.

TABLE 691

Segment location on transcripts

| Transcript name | Segment starting position | Segment ending position |
| --- | --- | --- |
| M78076_PEA_1_T2 (SEQ ID NO:74) | 1694 | 1952 |
| M78076_PEA_1_T5 (SEQ ID NO:76) | 1694 | 1952 |

Segment cluster M78076_PEA_1_node_37 (SEQ ID NO:669) according to the present invention is supported by 11 libraries. The number of libraries was determined as previously described. This segment can be found in the following transcript(s): M78076_PEA_1_T3 (SEQ ID NO:75) and M78076_PEA_1_T5 (SEQ ID NO:76). Table 692 below describes the starting and ending position of this segment on each transcript.

TABLE 692

Segment location on transcripts

| Transcript name | Segment starting position | Segment ending position |
| --- | --- | --- |
| M78076_PEA_1_T3 (SEQ ID NO:75) | 1718 | 2180 |
| M78076_PEA_1_T5 (SEQ ID NO:76) | 1977 | 2439 |

Segment cluster M78076_PEA_1_node_46 (SEQ ID NO:670) according to the present invention is supported by 3 libraries. The number of libraries was determined as previously described. This segment can be found in the following transcript(s): M78076_PEA_1_T15 (SEQ ID NO:78). Table 693 below describes the starting and ending position of this segment on each transcript.

TABLE 693

Segment location on transcripts

| Transcript name | Segment starting position | Segment ending position |
| --- | --- | --- |
| M78076_PEA_1_T15 (SEQ ID NO:78) | 1852 | 1972 |

Segment cluster M78076_PEA_1_node_47 (SEQ ID NO:671) according to the present invention is supported by 155 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 694 below describes the starting and ending position of this segment on each transcript.

TABLE 694

Segment location on transcripts

| Transcript name | Segment starting position | Segment ending position |
|---|---|---|
| M78076_PEA_1_T2 (SEQ ID NO:74) | 2111 | 2254 |
| M78076_PEA_1_T3 (SEQ ID NO:75) | 2327 | 2470 |
| M78076_PEA_1_T5 (SEQ ID NO:76) | 2586 | 2729 |
| M78076_PEA_1_T13 (SEQ ID NO:77) | 1781 | 1924 |
| M78076_PEA_1_T15 (SEQ ID NO:78) | 1973 | 2116 |
| M78076_PEA_1_T23 (SEQ ID NO:79) | 1693 | 1836 |

Segment cluster M78076_PEA_1_node_54 (SEQ ID NO:672) according to the present invention is supported by 133 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79) and M78076_PEA_1_T28 (SEQ ID NO:82). Table 695 below describes the starting and ending position of this segment on each transcript.

TABLE 695

Segment location on transcripts

| Transcript name | Segment starting position | Segment ending position |
|---|---|---|
| M78076_PEA_1_T2 (SEQ ID NO:74) | 2412 | 2715 |
| M78076_PEA_1_T3 (SEQ ID NO:75) | 2628 | 2931 |
| M78076_PEA_1_T5 (SEQ ID NO:76) | 2887 | 3190 |
| M78076_PEA_1_T13 (SEQ ID NO:77) | 2082 | 2385 |
| M78076_PEA_1_T15 (SEQ ID NO:78) | 2274 | 2577 |
| M78076_PEA_1_T23 (SEQ ID NO:79) | 1994 | 2297 |
| M78076_PEA_1_T28 (SEQ ID NO:82) | 1492 | 1795 |

According to an optional embodiment of the present invention, short segments related to the above cluster are also provided. These segments are up to about 120 bp in length, and so are included in a separate description.

Segment cluster M78076_PEA_1_node_1 (SEQ ID NO:673) according to the present invention is supported by 47 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 696 below describes the starting and ending position of this segment on each transcript.

TABLE 696

Segment location on transcripts

| Transcript name | Segment starting position | Segment ending position |
|---|---|---|
| M78076_PEA_1_T2 (SEQ ID NO:74) | 161 | 204 |
| M78076_PEA_1_T3 (SEQ ID NO:75) | 161 | 204 |
| M78076_PEA_1_T5 (SEQ ID NO:76) | 161 | 204 |
| M78076_PEA_1_T13 (SEQ ID NO:77) | 161 | 204 |
| M78076_PEA_1_T15 (SEQ ID NO:78) | 161 | 204 |
| M78076_PEA_1_T23 (SEQ ID NO:79) | 161 | 204 |
| M78076_PEA_1_T26 (SEQ ID NO:80) | 161 | 204 |
| M78076_PEA_1_T27 (SEQ ID NO:81) | 161 | 204 |
| M78076_PEA_1_T28 (SEQ ID NO:82) | 161 | 204 |

Segment cluster M78076_PEA_1_node_2 (SEQ ID NO:674) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 697 below describes the starting and ending position of this segment on each transcript.

TABLE 697

Segment location on transcripts

| Transcript name | Segment starting position | Segment ending position |
|---|---|---|
| M78076_PEA_1_T2 (SEQ ID NO:74) | 205 | 224 |
| M78076_PEA_1_T3 (SEQ ID NO:75) | 205 | 224 |
| M78076_PEA_1_T5 (SEQ ID NO:76) | 205 | 224 |
| M78076_PEA_1_T13 (SEQ ID NO:77) | 205 | 224 |
| M78076_PEA_1_T15 (SEQ ID NO:78) | 205 | 224 |
| M78076_PEA_1_T23 (SEQ ID NO:79) | 205 | 224 |
| M78076_PEA_1_T26 (SEQ ID NO:80) | 205 | 224 |
| M78076_PEA_1_T27 (SEQ ID NO:81) | 205 | 224 |
| M78076_PEA_1_T28 (SEQ ID NO:82) | 205 | 224 |

Segment cluster M78076_PEA_1_node_3 (SEQ ID NO:675) according to the present invention is supported by 52 libraries. The number of libraries was determined as previously described. This segment can be found in the following transcript(s): M78076_PEA_1_T2 (SEQ ID NO:74), M78076 PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 698 below describes the starting and ending position of this segment on each transcript.

TABLE 698

Segment location on transcripts

| Transcript name | Segment starting position | Segment ending position |
|---|---|---|
| M78076_PEA_1_T2 (SEQ ID NO:74) | 225 | 288 |
| M78076_PEA_1_T3 (SEQ ID NO:75) | 225 | 288 |

TABLE 698-continued

Segment location on transcripts

| Transcript name | Segment starting position | Segment ending position |
|---|---|---|
| M78076_PEA_1_T5 (SEQ ID NO:76) | 225 | 288 |
| M78076_PEA_1_T13 (SEQ ID NO:77) | 225 | 288 |
| M78076_PEA_1_T15 (SEQ ID NO:78) | 225 | 288 |
| M78076_PEA_1_T23 (SEQ ID NO:79) | 225 | 288 |
| M78076_PEA_1_T26 (SEQ ID NO:80) | 225 | 288 |
| M78076_PEA_1_T27 (SEQ ID NO:81) | 225 | 288 |
| M78076_PEA_1_T28 (SEQ ID NO:82) | 225 | 288 |

Segment cluster M78076_PEA_1_node_6 (SEQ ID NO:676) according to the present invention is supported by 59 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 699 below describes the starting and ending position of this segment on each transcript.

TABLE 699

Segment location on transcripts

| Transcript name | Segment starting position | Segment ending position |
|---|---|---|
| M78076_PEA_1_T2 (SEQ ID NO:74) | 289 | 370 |
| M78076_PEA_1_T3 (SEQ ID NO:75) | 289 | 370 |
| M78076_PEA_1_T5 (SEQ ID NO:76) | 289 | 370 |
| M78076_PEA_1_T13 (SEQ ID NO:77) | 289 | 370 |
| M78076_PEA_1_T15 (SEQ ID NO:78) | 289 | 370 |
| M78076_PEA_1_T23 (SEQ ID NO:79) | 289 | 370 |
| M78076_PEA_1_T26 (SEQ ID NO:80) | 289 | 370 |
| M78076_PEA_1_T27 (SEQ ID NO:81) | 289 | 370 |
| M78076_PEA_1_T28 (SEQ ID NO:82) | 289 | 370 |

Segment cluster M78076_PEA_1_node_7 (SEQ ID NO:677) according to the present invention is supported by 64 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 700 below describes the starting and ending position of this segment on each transcript.

TABLE 700

Segment location on transcripts

| Transcript name | Segment starting position | Segment ending position |
|---|---|---|
| M78076_PEA_1_T2 (SEQ ID NO:74) | 371 | 432 |
| M78076_PEA_1_T3 (SEQ ID NO:75) | 371 | 432 |

TABLE 700-continued

Segment location on transcripts

| Transcript name | Segment starting position | Segment ending position |
|---|---|---|
| M78076_PEA_1_T5 (SEQ ID NO:76) | 371 | 432 |
| M78076_PEA_1_T13 (SEQ ID NO:77) | 371 | 432 |
| M78076_PEA_1_T15 (SEQ ID NO:78) | 371 | 432 |
| M78076_PEA_1_T23 (SEQ ID NO:79) | 371 | 432 |
| M78076_PEA_1_T26 (SEQ ID NO:80) | 371 | 432 |
| M78076_PEA_1_T27 (SEQ ID NO:81) | 371 | 432 |
| M78076_PEA_1_T28 (SEQ ID NO:82) | 371 | 432 |

Segment cluster M78076_PEA_1_node_12 (SEQ ID NO:678) according to the present invention is supported by 71 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 701 below describes the starting and ending position of this segment on each transcript.

TABLE 701

Segment location on transcripts

| Transcript name | Segment starting position | Segment ending position |
|---|---|---|
| M78076_PEA_1_T2 (SEQ ID NO:74) | 566 | 678 |
| M78076_PEA_1_T3 (SEQ ID NO:75) | 566 | 678 |
| M78076_PEA_1_T5 (SEQ ID NO:76) | 566 | 678 |
| M78076_PEA_1_T13 (SEQ ID NO:77) | 566 | 678 |
| M78076_PEA_1_T15 (SEQ ID NO:78) | 566 | 678 |
| M78076_PEA_1_T23 (SEQ ID NO:79) | 566 | 678 |
| M78076_PEA_1_T26 (SEQ ID NO:80) | 566 | 678 |
| M78076_PEA_1_T27 (SEQ ID NO:81) | 566 | 678 |
| M78076_PEA_1_T28 (SEQ ID NO:82) | 566 | 678 |

Segment cluster M78076_PEA_1_node_22 (SEQ ID NO:679) according to the present invention is supported by 92 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80), M78076_PEA_1_T27 (SEQ ID NO:81) and M78076_PEA_1_T28 (SEQ ID NO:82). Table 702 below describes the starting and ending position of this segment on each transcript.

TABLE 702

Segment location on transcripts

| Transcript name | Segment starting position | Segment ending position |
|---|---|---|
| M78076_PEA_1_T2 (SEQ ID NO:74) | 1123 | 1197 |
| M78076_PEA_1_T3 (SEQ ID NO:75) | 1123 | 1197 |

TABLE 702-continued

Segment location on transcripts

| Transcript name | Segment starting position | Segment ending position |
|---|---|---|
| M78076_PEA_1_T5 (SEQ ID NO:76) | 1123 | 1197 |
| M78076_PEA_1_T13 (SEQ ID NO:77) | 1123 | 1197 |
| M78076_PEA_1_T15 (SEQ ID NO:78) | 1123 | 1197 |
| M78076_PEA_1_T23 (SEQ ID NO:79) | 1123 | 1197 |
| M78076_PEA_1_T26 (SEQ ID NO:80) | 1123 | 1197 |
| M78076_PEA_1_T27 (SEQ ID NO:81) | 1123 | 1197 |
| M78076_PEA_1_T28 (SEQ ID NO:82) | 1123 | 1197 |

Segment cluster M78076_PEA_1_node_27 (SEQ ID NO:680) according to the present invention can be found in the following transcript(s): M78076_PEA_1_T27 (SEQ ID NO:81). Table 703 below describes the starting and ending position of this segment on each transcript.

TABLE 703

Segment location on transcripts

| Transcript name | Segment starting position | Segment ending position |
|---|---|---|
| M78076_PEA_1_T27 (SEQ ID NO:81) | 1486 | 1489 |

Segment cluster M78076_PEA_1_node_30 (SEQ ID NO:681) according to the present invention is supported by 90 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80) and M78076_PEA_1_T27 (SEQ ID NO:81). Table 704 below describes the starting and ending position of this segment on each transcript.

TABLE 704

Segment location on transcripts

| Transcript name | Segment starting position | Segment ending position |
|---|---|---|
| M78076_PEA_1_T2 (SEQ ID NO:74) | 1486 | 1557 |
| M78076_PEA_1_T3 (SEQ ID NO:75) | 1486 | 1557 |
| M78076_PEA_1_T5 (SEQ ID NO:76) | 1486 | 1557 |
| M78076_PEA_1_T13 (SEQ ID NO:77) | 1486 | 1557 |
| M78076_PEA_1_T15 (SEQ ID NO:78) | 1486 | 1557 |
| M78076_PEA_1_T23 (SEQ ID NO:79) | 1327 | 1398 |
| M78076_PEA_1_T26 (SEQ ID NO:80) | 1486 | 1557 |
| M78076_PEA_1_T27 (SEQ ID NO:81) | 3133 | 3204 |

Segment cluster M78076_PEA_1_node_31 (SEQ ID NO:682) according to the present invention is supported by 89 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79), M78076_PEA_1_T26 (SEQ ID NO:80) and M78076_PEA_1_T27 (SEQ ID NO:81). Table 705 below describes the starting and ending position of this segment on each transcript.

TABLE 705

Segment location on transcripts

| Transcript name | Segment starting position | Segment ending position |
|---|---|---|
| M78076_PEA_1_T2 (SEQ ID NO:74) | 1558 | 1585 |
| M78076_PEA_1_T3 (SEQ ID NO:75) | 1558 | 1585 |
| M78076_PEA_1_T5 (SEQ ID NO:76) | 1558 | 1585 |
| M78076_PEA_1_T13 (SEQ ID NO:77) | 1558 | 1585 |
| M78076_PEA_1_T15 (SEQ ID NO:78) | 1558 | 1585 |
| M78076_PEA_1_T23 (SEQ ID NO:79) | 1399 | 1426 |
| M78076_PEA_1_T26 (SEQ ID NO:80) | 1558 | 1585 |
| M78076_PEA_1_T27 (SEQ ID NO:81) | 3205 | 3232 |

Segment cluster M78076_PEA_1_node_34 (SEQ ID NO:683) according to the present invention is supported by 103 libraries. The number of libraries was determined as previously described. This segment can be found in the following transcript(s): M78076_PEA_1_T2 (SEQ ID NO:74), M78076 PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 706 below describes the starting and ending position of this segment on each transcript.

TABLE 706

Segment location on transcripts

| Transcript name | Segment starting position | Segment ending position |
|---|---|---|
| M78076_PEA_1_T2 (SEQ ID NO:74) | 1586 | 1693 |
| M78076_PEA_1_T3 (SEQ ID NO:75) | 1586 | 1693 |
| M78076_PEA_1_T5 (SEQ ID NO:76) | 1586 | 1693 |
| M78076_PEA_1_T13 (SEQ ID NO:77) | 1586 | 1693 |
| M78076_PEA_1_T15 (SEQ ID NO:78) | 1586 | 1693 |
| M78076_PEA_1_T23 (SEQ ID NO:79) | 1427 | 1534 |

Segment cluster M78076_PEA_1_node_36 (SEQ ID NO:684) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 707 below describes the starting and ending position of this segment on each transcript.

TABLE 707

Segment location on transcripts

| Transcript name | Segment starting position | Segment ending position |
|---|---|---|
| M78076_PEA_1_T2 (SEQ ID NO:74) | 1953 | 1976 |
| M78076_PEA_1_T3 (SEQ ID NO:75) | 1694 | 1717 |
| M78076_PEA_1_T5 (SEQ ID NO:76) | 1953 | 1976 |
| M78076_PEA_1_T13 (SEQ ID NO:77) | 1694 | 1717 |
| M78076_PEA_1_T15 (SEQ ID NO:78) | 1694 | 1717 |
| M78076_PEA_1_T23 (SEQ ID NO:79) | 1535 | 1558 |

Segment cluster M78076_PEA_1_node_41 (SEQ ID NO:685) according to the present invention can be found in the following transcript(s): M78076_PEA_1_T3 (SEQ ID NO:75) and M78076_PEA_1_T5 (SEQ ID NO:76). Table 708 below describes the starting and ending position of this segment on each transcript.

TABLE 708

Segment location on transcripts

| Transcript name | Segment starting position | Segment ending position |
|---|---|---|
| M78076_PEA_1_T3 (SEQ ID NO:75) | 2181 | 2192 |
| M78076_PEA_1_T5 (SEQ ID NO:76) | 2440 | 2451 |

Segment cluster M78076_PEA_1_node_42 (SEQ ID NO:686) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T15 (SEQ ID NO:78) and M78076_PEA_1_T23 (SEQ ID NO:79). Table 709 below describes the starting and ending position of this segment on each transcript.

TABLE 709

Segment location on transcripts

| Transcript name | Segment starting position | Segment ending position |
|---|---|---|
| M78076_PEA_1_T2 (SEQ ID NO:74) | 1977 | 1985 |
| M78076_PEA_1_T3 (SEQ ID NO:75) | 2193 | 2201 |
| M78076_PEA_1_T5 (SEQ ID NO:76) | 2452 | 2460 |
| M78076_PEA_1_T15 (SEQ ID NO:78) | 1718 | 1726 |
| M78076_PEA_1_T23 (SEQ ID NO:79) | 1559 | 1567 |

Segment cluster M78076_PEA_1_node_43 (SEQ ID NO:687) according to the present invention is supported by 110 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T15 (SEQ ID NO:78) and M78076_PEA_1_T23 (SEQ ID NO:79). Table 710 below describes the starting and ending position of this segment on each transcript.

TABLE 710

Segment location on transcripts

| Transcript name | Segment starting position | Segment ending position |
|---|---|---|
| M78076_PEA_1_T2 (SEQ ID NO:74) | 1986 | 2047 |
| M78076_PEA_1_T3 (SEQ ID NO:75) | 2202 | 2263 |
| M78076_PEA_1_T5 (SEQ ID NO:76) | 2461 | 2522 |
| M78076_PEA_1_T15 (SEQ ID NO:78) | 1727 | 1788 |
| M78076_PEA_1_T23 (SEQ ID NO:79) | 1568 | 1629 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 711.

TABLE 711

Oligonucleotides related to this segment

| Oligonucleotide name | Overexpressed in cancers | Chip reference |
|---|---|---|
| M78076_0_7_0 (SEQ ID NO: 232) | lung malignant tumors | LUN |

Segment cluster M78076_PEA_1_node_45 (SEQ ID NO:688) according to the present invention is supported by 132 libraries. The number of libraries was determined as previously described. This segment can be found in the following transcript(s): M78076_PEA_1_T2 (SEQ ID NO:74), M78076 PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 712 below describes the starting and ending position of this segment on each transcript.

TABLE 712

Segment location on transcripts

| Transcript name | Segment starting position | Segment ending position |
|---|---|---|
| M78076_PEA_1_T2 (SEQ ID NO:74) | 2048 | 2110 |
| M78076_PEA_1_T3 (SEQ ID NO:75) | 2264 | 2326 |
| M78076_PEA_1_T5 (SEQ ID NO:76) | 2523 | 2585 |
| M78076_PEA_1_T13 (SEQ ID NO:77) | 1718 | 1780 |
| M78076_PEA_1_T15 (SEQ ID NO:78) | 1789 | 1851 |
| M78076_PEA_1_T23 (SEQ ID NO:79) | 1630 | 1692 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 713.

TABLE 713

Oligonucleotides related to this segment

| Oligonucleotide name | Overexpressed in cancers | Chip reference |
|---|---|---|
| M78076_0_7_0 (SEQ ID NO: 232) | lung malignant tumors | LUN |

Segment cluster M78076_PEA_1_node_49 (SEQ ID NO:689) according to the present invention is supported by 129 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 714 below describes the starting and ending position of this segment on each transcript.

TABLE 714

Segment location on transcripts

| Transcript name | Segment starting position | Segment ending position |
|---|---|---|
| M78076_PEA_1_T2 (SEQ ID NO:74) | 2255 | 2290 |
| M78076_PEA_1_T3 (SEQ ID NO:75) | 2471 | 2506 |
| M78076_PEA_1_T5 (SEQ ID NO:76) | 2730 | 2765 |
| M78076_PEA_1_T13 (SEQ ID NO:77) | 1925 | 1960 |
| M78076_PEA_1_T15 (SEQ ID NO:78) | 2117 | 2152 |
| M78076_PEA_1_T23 (SEQ ID NO:79) | 1837 | 1872 |

Segment cluster M78076_PEA_1_node_50 (SEQ ID NO:690) according to the present invention is supported by 125 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 715 below describes the starting and ending position of this segment on each transcript.

TABLE 715

Segment location on transcripts

| Transcript name | Segment starting position | Segment ending position |
|---|---|---|
| M78076_PEA_1_T2 (SEQ ID NO:74) | 2291 | 2329 |
| M78076_PEA_1_T3 (SEQ ID NO:75) | 2507 | 2545 |
| M78076_PEA_1_T5 (SEQ ID NO:76) | 2766 | 2804 |
| M78076_PEA_1_T13 (SEQ ID NO:77) | 1961 | 1999 |
| M78076_PEA_1_T15 (SEQ ID NO:78) | 2153 | 2191 |
| M78076_PEA_1_T23 (SEQ ID NO:79) | 1873 | 1911 |

Segment cluster M78076_PEA_1_node_51 (SEQ ID NO:691) according to the present invention is supported by 123 libraries. The number of libraries was determined as previously described. This segment can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 716 below describes the starting and ending position of this segment on each transcript.

TABLE 716

Segment location on transcripts

| Transcript name | Segment starting position | Segment ending position |
|---|---|---|
| M78076_PEA_1_T2 (SEQ ID NO:74) | 2330 | 2388 |
| M78076_PEA_1_T3 (SEQ ID NO:75) | 2546 | 2604 |
| M78076_PEA_1_T5 (SEQ ID NO:76) | 2805 | 2863 |
| M78076_PEA_1_T13 (SEQ ID NO:77) | 2000 | 2058 |
| M78076_PEA_1_T15 (SEQ ID NO:78) | 2192 | 2250 |
| M78076_PEA_1_T23 (SEQ ID NO:79) | 1912 | 1970 |

Segment cluster M78076_PEA_1_node_52 (SEQ ID NO:692) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78) and M78076_PEA_1_T23 (SEQ ID NO:79). Table 717 below describes the starting and ending position of this segment on each transcript.

TABLE 717

Segment location on transcripts

| Transcript name | Segment starting position | Segment ending position |
|---|---|---|
| M78076_PEA_1_T2 (SEQ ID NO:74) | 2389 | 2405 |
| M78076_PEA_1_T3 (SEQ ID NO:75) | 2605 | 2621 |
| M78076_PEA_1_T5 (SEQ ID NO:76) | 2864 | 2880 |
| M78076_PEA_1_T13 (SEQ ID NO:77) | 2059 | 2075 |
| M78076_PEA_1_T15 (SEQ ID NO:78) | 2251 | 2267 |
| M78076_PEA_1_T23 (SEQ ID NO:79) | 1971 | 1987 |

Segment cluster M78076_PEA_1_node_53 (SEQ ID NO:693) according to the present invention can be found in the following transcript(s): M78076_PEA_1_T2 (SEQ ID NO:74), M78076_PEA_1_T3 (SEQ ID NO:75), M78076_PEA_1_T5 (SEQ ID NO:76), M78076_PEA_1_T13 (SEQ ID NO:77), M78076_PEA_1_T15 (SEQ ID NO:78), M78076_PEA_1_T23 (SEQ ID NO:79) and M78076_PEA_1_T28 (SEQ ID NO:82). Table 718 below describes the starting and ending position of this segment on each transcript.

TABLE 718

Segment location on transcripts

| Transcript name | Segment starting position | Segment ending position |
|---|---|---|
| M78076_PEA_1_T2 (SEQ ID NO:74) | 2406 | 2411 |
| M78076_PEA_1_T3 (SEQ ID NO:75) | 2622 | 2627 |
| M78076_PEA_1_T5 (SEQ ID NO:76) | 2881 | 2886 |
| M78076_PEA_1_T13 (SEQ ID NO:77) | 2076 | 2081 |
| M78076_PEA_1_T15 (SEQ ID NO:78) | 2268 | 2273 |
| M78076_PEA_1_T23 (SEQ ID NO:79) | 1988 | 1993 |
| M78076_PEA_1_T28 (SEQ ID NO:82) | 1486 | 1491 |

Variant protein alignment to the previously known protein:

Sequence name: APP1_HUMAN (SEQ ID NO:1439)

Sequence documentation:

Alignment of: M78076_PEA_1_P3 (SEQ ID NO:1350) x APP1_HUMAN (SEQ ID NO:1439)

Alignment segment 1/1:

Quality: 5132.00
Matching length: 517
Matching Percent Similarity: 100.00
Total Percent Similarity: 100.00
Gaps: 0

Escore: 0
Total length: 517
Matching Percent Identity: 100.00
Total Percent Identity: 100.00

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIQELLHSEHLGPSELEAPAP 500
    ||||||||||||||||||||||||||||||||||||||||||||||||||
451 THLQVIEERVNQSLGLLDQNPHLAQELRPQIQELLHSEHLGPSELEAPAP 500

501 GGSSEDKGGLQPPDSKD                                 517
    |||||||||||||||||
501 GGSSEDKGGLQPPDSKD                                 517
```

Sequence name: APP1_HUMAN (SEQ ID NO:1439)
Sequence documentation:
Alignment of: M78076_PEA_1_P4 (SEQ ID NO:1351) x APP1 HUMAN (SEQ ID NO:1439)

Alignment segment 1/1:

| Quality: 5223.00 | Escore: 0 |
|---|---|
| Matching length: 526 | Total length: 526 |

| Matching Percent Similarity: 100.00 | Matching Percent Identity: 100.00 |
|---|---|
| Total Percent Similarity: 100.00 | Total Percent Identity: 100.00 |
| Gaps: 0 | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300
```

```
301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIQELLHSEHLGPSELEAPAP 500
    ||||||||||||||||||||||||||||||||||||||||||||||||||
451 THLQVIEERVNQSLGLLDQNPHLAQELRPQIQELLHSEHLGPSELEAPAP 500

501 GGSSEDKGGLQPPDSKDDTPMTLPKG                         526
    ||||||||||||||||||||||||||
501 GGSSEDKGGLQPPDSKDDTPMTLPKG                         526
```

Sequence name: APP1_HUMAN (SEQ ID NO:1439)

Sequence documentation:

Alignment of: M78076_PEA_1_P12 (SEQ ID NO:1352) x APP1_HUMAN (SEQ ID NO:1439)...

Quality: 5223.00  
Matching length: 526  
Matching Percent Similarity: 100.00  
Total Percent Similarity: 100.00  
Gaps: 0

Escore: 0  
Total length: 526  
Matching Percent Identity: 100.00  
Total Percent Identity: 100.00

Alignment segment 1/1:

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIQELLHSEHLGPSELEAPAP 500
    ||||||||||||||||||||||||||||||||||||||||||||||||||
451 THLQVIEERVNQSLGLLDQNPHLAQELRPQIQELLHSEHLGPSELEAPAP 500

501 GGSSEDKGGLQPPDSKDDTPMTLPKG                         526
    ||||||||||||||||||||||||||
501 GGSSEDKGGLQPPDSKDDTPMTLPKG                         526
```

607

Sequence name: APP1_HUMAN (SEQ ID NO:1439)

Sequence documentation:

Alignment of: M78076_PEA__1_P14 (SEQ ID NO:1353) x APP1_HUMAN (SEQ ID NO:1439) . . .

Alignment segment 1/1:

| | |
|---|---|
| Quality: 5672.00 | Escore: 0 |
| Matching length: 575 | Total length: 575 |
| Matching Percent Similarity: 99.48 | Matching Percent Identity: 99.48 |
| Total Percent Similarity: 99.48 | Total Percent Identity: 99.48 |
| Gaps: 0 | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIQELLHSEHLGPSELEAPAP 500
    ||||||||||||||||||||||||||||||||||||||||||||||||||
451 THLQVIEERVNQSLGLLDQNPHLAQELRPQIQELLHSEHLGPSELEAPAP 500

501 GGSSEDKGGLQPPDSKDDTPMTLPKGSTEQDAASPEKEKMNPLEQYERKV 550
    ||||||||||||||||||||||||||||||||||||||||||||||||||
501 GGSSEDKGGLQPPDSKDDTPMTLPKGSTEQDAASPEKEKMNPLEQYERKV 550

551 NASVPRGFPFHSSEIQRDELVRGGT                         575
    |||||||||||||||||||||  |
551 NASVPRGFPFHSSEIQRDELAPAGT                         575
```

608

Sequence name: APP1_HUMAN (SEQ ID NO:1439)

Sequence documentation:

Alignment of: M78076_PEA__1_P21 (SEQ ID NO:1354) x APP1_HUMAN (SEQ ID NO:1439) . . .

Alignment segment 1/1:

| | |
|---|---|
| Quality: 5822.00 | Escore: 0 |
| Matching length: 597 | Total length: 650 |
| Matching Percent Similarity: 100.00 | Matching Percent Identity: 100.00 |
| Total Percent Similarity: 91.85 | Total Percent Identity: 91.85 |
| Gaps: 1 | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200
```

-continued

```
201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NE................................................ 352
    ||
351 NEHFQSILQTLEEQVSGERQRLVETHATRVIALINDQRRAALEGFLAALQ 400

353 .....AERVLLALRRYLRAEQKEQRHTLRHYQHVAAVDPEKAQQMRFQVH 397
         |||||||||||||||||||||||||||||||||||||||||||||
401 ADPPQAERVLLALRRYLRAEQKEQRHTLRHYQHVAAVDPEKAQQMRFQVH 450

398 THLQVIEERVNQSLGLLDQNPHLAQELRPQIQELLHSEHLGPSELEAPAP 447
    ||||||||||||||||||||||||||||||||||||||||||||||||||
451 THLQVIEERVNQSLGLLDQNPHLAQELRPQIQELLHSEHLGPSELEAPAP 500

448 GGSSEDKGGLQPPDSKDDTPMTLPKGSTEQDAASPEKEKMNPLEQYERKV 497
    ||||||||||||||||||||||||||||||||||||||||||||||||||
501 GGSSEDKGGLQPPDSKDDTPMTLPKGSTEQDAASPEKEKMNPLEQYERKV 550

498 NASVPRGFPFHSSEIQRDELAPAGTGVSREAVSGLLIMGAGGGSLIVLSM 547
    ||||||||||||||||||||||||||||||||||||||||||||||||||
551 NASVPRGFPFHSSEIQRDELAPAGTGVSREAVSGLLIMGAGGGSLIVLSM 600

548 LLLRRKKPYGAISHGVVEVDPMLTLEEQQLRELQRHGYENPTYRFLEERP 597
    ||||||||||||||||||||||||||||||||||||||||||||||||||
601 LLLRRKKPYGAISHGVVEVDPMLTLEEQQLRELQRHGYENPTYRFLEERP 650
```

Sequence name: APP1_HUMAN (SEQ ID NO:1439)

Sequence documentation:

Alignment of: M78076_PEA_1_P24 (SEQ ID NO:1355) x APP1_HUMAN (SEQ ID NO:1439)...

| | |
|---|---|
| Quality: 4791.00 | Escore: 0 |
| Matching length: 485 | Total length: 485 |
| Matching Percent Similarity: 99.79 | Matching Percent Identity: 99.59 |
| Total Percent Similarity: 99.79 | Total Percent Identity: 99.59 |
| Gaps: 0 | |

Alignment segment 1/1:

Alignment:

```
  1 MGPASPAARGLSRRPGQPPLPLLLPLLLLLLRAQPAIGSLAGGSPGAAEA 50
    ||||||||||||||||||||||||||||||||||||||||||||||||||
  1 MGPASPAARGLSRRPGQPPLPLLLPLLLLLLRAQPAIGSLAGGSPGAAEA 50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400
```

```
401 ADPPQAERVLLALRRYLRAEQKEQRHTLRHYQHVAAVDPEKAQQMRFQVH 450
    ||||||||||||||||||||||||||||||||||||||||||||||||||
401 ADPPQAERVLLALRRYLRAEQKEQRHTLRHYQHVAAVDPEKAQQMRFQVH 450

451 THLQVIEERVNQSLGLLDQNPHLAQELRPQIRECL        485
    ||||||||||||||||||||||||||||||||:||
451 THLQVIEERVNQSLGLLDQNPHLAQELRPQIQELL        485
```

Sequence name: APP1_HUMAN (SEQ ID NO:1439)

Sequence documentation:

Alignment of: M78076_PEA_1_P2 (SEQ ID NO:1356) x APP1_HUMAN (SEQ ID NO:1439)

Alignment segment 1/1:

| Quality: 4474.00 | Escore: 0 |
|---|---|
| Matching length: 454 | Total length: 454 |
| Matching Percent Similarity: 99.56 | Matching Percent Identity: 99.34 |
| Total Percent Similarity: 99.56 | Total Percent Identity: 99.34 |
| Gaps: 0 | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50

51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQVL 450
    ||||||||||||||||||||||||||||||||||||||||||||||||:
401 ADPPQAERVLLALRRYLRAEQKEQRHTLRHYQHVAAVDPEKAQQMRFQVH 450

451 TSFQ 454
    |:|
451 THLQ 454
```

Sequence name: APP1_HUMAN (SEQ ID NO:1439)

Sequence documentation:

Alignment of: M78076_PEA_1_P25 (SEQ ID NO:1357) x APP1_HUMAN (SEQ ID NO:1439)...

Alignment segment 1/1:

| Quality: 4455.00 | Escore: 0 |
|---|---|
| Matching length: 448 | Total length: 448 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1 MGPASPAARGLSRRPGQPPLPLLLPLLLLLLRAQPAIGSLAGGSPGAAEA  50
    ||||||||||||||||||||||||||||||||||||||||||||||||||
  1 MGPASPAARGLSRRPGQPPLPLLLPLLLLLLRAQPAIGSLAGGSPGAAEA  50
```

```
 51 PGSAQVAGLCGRLTLHRDLRTGRWEPDPQRSRRCLRDPQRVLEYCRQMYP 100
    ||||||||||||||||||||||||||||||||||||||||||||||||||
 51 PGSAQVAGLCGRLTLHRDLRTGRWEPDPQRSRRCLRDPQRVLEYCRQMYP 100

101 ELQIARVEQATQAIPMERWCGGSRSGSCAHPHHQVVPFRCLPGEFVSEAL 150
    ||||||||||||||||||||||||||||||||||||||||||||||||||
101 ELQIARVEQATQAIPMERWCGGSRSGSCAHPHHQVVPFRCLPGEFVSEAL 150

151 LVPEGCRFLHQERMDQCESSTRRHQEAQEACSSQGLILHGSGMLLPCGSD 200
    ||||||||||||||||||||||||||||||||||||||||||||||||||
151 LVPEGCRFLHQERMDQCESSTRRHQEAQEACSSQGLILHGSGMLLPCGSD 200

201 RFRGVEYVCCPPPGTPDPSGTAVGDPSTRSWPPGSRVEGAEDEEEEESFP 250
    ||||||||||||||||||||||||||||||||||||||||||||||||||
201 RFRGVEYVCCPPPGTPDPSGTAVGDPSTRSWPPGSRVEGAEDEEEEESFP 250

251 QPVDDYFVEPPQAEEEEETVPPPSSHTLAVVGKVTPTPRPTDGVDIYFGM 300
    ||||||||||||||||||||||||||||||||||||||||||||||||||
251 QPVDDYFVEPPQAEEEEETVPPPSSHTLAVVGKVTPTPRPTDGVDIYFGM 300

301 PGEISEHEGFLRAKMDLEERRMRQINEVMREWAMADNQSKNLPKADRQAL 350
    ||||||||||||||||||||||||||||||||||||||||||||||||||
301 PGEISEHEGFLRAKMDLEERRMRQINEVMREWAMADNQSKNLPKADRQAL 350

351 NEHFQSILQTLEEQVSGERQRLVETHATRVIALINDQRRAALEGFLAALQ 400
    ||||||||||||||||||||||||||||||||||||||||||||||||||
351 NEHFQSILQTLEEQVSGERQRLVETHATRVIALINDQRRAALEGFLAALQ 400

401 ADPPQAERVLLALRRYLRAEQKEQRHTLRHYQHVAAVDPEKAQQMRFQ 448
    ||||||||||||||||||||||||||||||||||||||||||||||||
401 ADPPQAERVLLALRRYLRAEQKEQRHTLRHYQHVAAVDPEKAQQMRFQ 448
```

Description for Cluster T99080

Cluster T99080 features 14 transcript(s) and 11 segment(s) of interest, the names for which are given in Tables 719 and 720, respectively, the sequences themselves are given at the end of the application. The selected protein variants are given in table 721.

TABLE 719

Transcripts of interest

| Transcript Name | Sequence ID No. |
| --- | --- |
| T99080_PEA_4_T0 | 83 |
| T99080_PEA_4_T2 | 84 |
| T99080_PEA_4_T4 | 85 |
| T99080_PEA_4_T6 | 86 |
| T99080_PEA_4_T9 | 87 |
| T99080_PEA_4_T10 | 88 |
| T99080_PEA_4_T11 | 89 |
| T99080_PEA_4_T13 | 90 |
| T99080_PEA_4_T14 | 91 |
| T99080_PEA_4_T17 | 92 |
| T99080_PEA_4_T18 | 93 |
| T99080_PEA_4_T19 | 94 |
| T99080_PEA_4_T20 | 95 |
| T99080_PEA_4_T21 | 96 |

TABLE 720

Segments of interest

| Segment Name | Sequence ID No. |
| --- | --- |
| T99080_PEA_4_node_1 | 695 |
| T99080_PEA_4_node_6 | 696 |
| T99080_PEA_4_node_11 | 697 |
| T99080_PEA_4_node_19 | 698 |
| T99080_PEA_4_node_20 | 699 |
| T99080_PEA_4_node_3 | 700 |
| T99080_PEA_4_node_5 | 701 |
| T99080_PEA_4_node_8 | 702 |
| T99080_PEA_4_node_13 | 703 |
| T99080_PEA_4_node_15 | 704 |
| T99080_PEA_4_node_18 | 705 |

TABLE 721

Proteins of interest

| Protein Name | Sequence ID No. | Corresponding Transcript(s) |
| --- | --- | --- |
| T99080_PEA_4_P1 | 1358 | T99080_PEA_4_T0 (SEQ ID NO:83) |
| T99080_PEA_4_P2 | 1359 | T99080_PEA_4_T2 (SEQ ID NO:84) |
| T99080_PEA_4_P5 | 1360 | T99080_PEA_4_T6 (SEQ ID NO:86) |
| T99080_PEA_4_P8 | 1361 | T99080_PEA_4_T9 (SEQ ID NO:87) |
| T99080_PEA_4_P9 | 1362 | T99080_PEA_4_T10 (SEQ ID NO:88) |
| T99080_PEA_4_P10 | 1363 | T99080_PEA_4_T11 (SEQ ID NO:89) |
| T99080_PEA_4_P12 | 1364 | T99080_PEA_4_T14 (SEQ ID NO:91) |
| T99080_PEA_4_P13 | 1365 | T99080_PEA_4_T17 (SEQ ID NO:92) |
| T99080_PEA_4_P14 | 1366 | T99080_PEA_4_T18 (SEQ ID NO:93) |
| T99080_PEA_4_P15 | 1367 | T99080_PEA_4_T19 (SEQ ID NO:94) |
| T99080_PEA_4_P16 | 1368 | T99080_PEA_4_T20 (SEQ ID NO:95) |
| T99080_PEA_4_P17 | 1369 | T99080_PEA_4_T21 (SEQ ID NO:96) |

These sequences are variants of the known protein Acylphosphatase, organ-common type isozyme (SwissProt accession identifier ACYO_HUMAN; known also according to the synonyms EC 3.6.1.7; Acylphosphate phosphohydrolase; Acylphosphatase, erythrocyte isozyme), SEQ ID NO: 1440, referred to herein as the previously known protein.

The sequence for protein Acylphosphatase (SEQ ID NO:1440), organ-common type isozyme is given at the end of the application, as "Acylphosphatase, organ-common type isozyme amino acid sequence". Known polymorphisms for this sequence are as shown in Table 722.

TABLE 722

Amino acid mutations for Known Protein

| SNP position(s) on amino acid sequence | Comment |
|---|---|
| 19 | G -> R |

The following GO Annotation(s) apply to the previously known protein. The following annotation(s) were found: phosphate metabolism, which are annotation(s) related to Biological Process; and acylphosphatase, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nihdot gov/projects/LocusLink/>.

As noted above, cluster T99080 features 14 transcript(s), which were listed in Table 719 above. These transcript(s) encode for protein(s) which are variant(s) of protein Acylphosphatase (SEQ ID NO:1440), organ-common type isozyme. A description of each variant protein according to the present invention is now provided.

Variant protein T99080_PEA_4_P1 (SEQ ID NO:1358) according to the present invention has an amino acid sequence as given at the end of the application; it is encoded by transcript(s) T99080_PEA_4_T0 (SEQ ID NO:83). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P1 (SEQ ID NO:1358) also has the following non-silent SNPs (Single Nucleotide Polymorphisms) as listed in Table 723, (given according to their position(s) on the amino acid sequence, with the alternative amino acid(s) listed; the last column indicates whether the SNP is known or not; the presence of known SNPs in variant protein T99080_PEA_4_P1 (SEQ ID NO:1358) sequence provides support for the deduced sequence of this variant protein according to the present invention).

TABLE 723

Amino acid mutations

| SNP position(s) on amino acid sequence | Alternative amino acid(s) | Previously known SNP? |
|---|---|---|
| 23 | A -> V | Yes |

Variant protein T99080_PEA_4_P1 (SEQ ID NO:1358) is encoded by the following transcript(s): T99080_PEA_4_T0 (SEQ ID NO:83), for which the sequence(s) is/are given at the end of the application. The coding portion of transcript T99080_PEA_4_T0 (SEQ ID NO:83) is shown in bold; this coding portion starts at position 226 and ends at position 411. The transcript also has the following SNPs as listed in Table 724 (given according to their position on the nucleotide sequence, with the alternative nucleic acid listed; the last column indicates whether the SNP is known or not; the presence of known SNPs in variant protein T99080_PEA_4_P1 (SEQ ID NO:1358) sequence provides support for the deduced sequence of this variant protein according to the present invention).

TABLE 724

Nucleic acid SNPs

| SNP position on nucleotide sequence | Alternative nucleic acid | Previously known SNP? |
|---|---|---|
| 293 | C -> T | Yes |
| 1293 | G -> C | Yes |
| 2034 | A -> G | Yes |
| 2114 | A -> C | Yes |
| 2153 | -> A | No |

Variant protein T99080_PEA_4_P2 (SEQ ID NO:1359) according to the present invention has an amino acid sequence as given at the end of the application; it is encoded by transcript(s) T99080_PEA_4_T2 (SEQ ID NO:84). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P2 (SEQ ID NO:1359) is encoded by the following transcript(s): T99080_PEA_4 T2 (SEQ ID NO:84), for which the sequence(s) is/are given at the end of the application. The coding portion of transcript T99080_PEA_4_T2 (SEQ ID NO:84) is shown in bold; this coding portion starts at position 1 and ends at position 192. The transcript also has the following SNPs as listed in Table 725 (given according to their position on the nucleotide sequence, with the alternative nucleic acid listed; the last column indicates whether the SNP is known or not; the presence of known SNPs in variant protein T99080_PEA_4_P2 (SEQ ID NO:1359) sequence provides support for the deduced sequence of this variant protein according to the present invention).

TABLE 725

Nucleic acid SNPs

| SNP position on nucleotide sequence | Alternative nucleic acid | Previously known SNP? |
|---|---|---|
| 1074 | G -> C | Yes |
| 1815 | A -> G | Yes |
| 1895 | A -> C | Yes |
| 1934 | -> A | No |

Variant protein T99080_PEA_4_P5 (SEQ ID NO:1360) according to the present invention has an amino acid sequence as given at the end of the application; it is encoded by transcript(s) T99080_PEA_4_T6 (SEQ ID NO:86). An alignment is given to the known protein (Acylphosphatase (SEQ ID NO:1440), organ-common type isozyme) at the end of the application. One or more alignments to one or more previously published protein sequences are given at the end of the application. A brief description of the relationship of the variant protein according to the present invention to each such aligned protein is as follows:

Comparison report between T99080_PEA_4_P5 (SEQ ID NO:1360) and ACYO_HUMAN_V1 (SEQ ID NO: 1441):

1. An isolated chimeric polypeptide encoding for T99080_PEA_4_P5 (SEQ ID NO:1360), comprising a first amino acid sequence being at least 70%, optionally at least 80%, preferably at least 85%, more preferably at least 90% and most preferably at least 95% homologous to a polypeptide having the sequence MPASARLAGAGLLLAFLRALG-CAGRAPGLS (SEQ ID NO:1732) corresponding to amino acids 1-30 of T99080_PEA_4_P5 (SEQ ID NO:1360), and a second amino acid sequence being at least 90% homologous to MAEGNTLISVDYEIFGKVQGVFFRKHTQAEGKK-LGLVGWVQNTDRGTVQGQLQGPISKVRHMQEWLET RGSPKSHIDKANFNNEKVILKLDYSDFQIVK corresponding to amino acids 1-99 of ACYO_HUMAN_V1 (SEQ ID NO:1441), which also corresponds to amino acids 31-129 of T99080_PEA_4_P5 (SEQ ID NO:1360), wherein said first amino acid sequence and second amino acid sequence are contiguous and in a sequential order.

2. An isolated polypeptide encoding for a head of T99080_PEA_4_P5 (SEQ ID NO:1360), comprising a polypeptide being at least 70%, optionally at least about 80%, preferably at least about 85%, more preferably at least about 90% and most preferably at least about 95% homologous to the sequence MPASARLAGAGLLLAFLRALGCA-GRAPGLS (SEQ ID NO:1732) of T99080_PEA_4_P5 (SEQ ID NO:1360).

It should be noted that the known protein sequence (ACYO_HUMAN (SEQ ID NO:1440)) has one or more changes than the sequence given at the end of the application and named as being the amino acid sequence for ACYO_HUMAN_V1 (SEQ ID NO:1441). These changes were previously known to occur and are listed in the table below.

TABLE 726

| Changes to ACYO_HUMAN_V1 (SEQ ID NO:1441) | |
| --- | --- |
| SNP position(s) on amino acid sequence | Type of change |
| 1 | init_met |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P5 (SEQ ID NO:1360) also has the following non-silent SNPs (Single Nucleotide Polymorphisms) as listed in Table 727, (given according to their position(s) on the amino acid sequence, with the alternative amino acid(s) listed; the last column indicates whether the SNP is known or not; the presence of known SNPs in variant protein T99080_PEA_4_P5 (SEQ ID NO:1360) sequence provides support for the deduced sequence of this variant protein according to the present invention).

TABLE 727

| Amino acid mutations | | |
| --- | --- | --- |
| SNP position(s) on amino acid sequence | Alternative amino acid(s) | Previously known SNP? |
| 23 | A -> V | Yes |

Variant protein T99080_PEA_4_P5 (SEQ ID NO:1360) is encoded by the following transcript(s): T99080_PEA_4_T6 (SEQ ID NO:86), for which the sequence(s) is/are given at the end of the application. The coding portion of transcript T99080_PEA_4_T6 (SEQ ID NO:86) is shown in bold; this coding portion starts at position 226 and ends at position 612. The transcript also has the following SNPs as listed in Table 728 (given according to their position on the nucleotide sequence, with the alternative nucleic acid listed; the last column indicates whether the SNP is known or not; the presence of known SNPs in variant protein T99080_PEA_4_P5 (SEQ ID NO:1360) sequence provides support for the deduced sequence of this variant protein according to the present invention).

TABLE 728

| Nucleic acid SNPs | | |
| --- | --- | --- |
| SNP position on nucleotide sequence | Alternative nucleic acid | Previously known SNP? |
| 293 | C -> T | Yes |
| 697 | A -> G | Yes |
| 777 | A -> C | Yes |
| 816 | -> A | No |

Variant protein T99080_PEA_4_P8 (SEQ ID NO:1361) according to the present invention has an amino acid sequence as given at the end of the application; it is encoded by transcript(s) T99080_PEA_4_T9 (SEQ ID NO:87). An alignment is given to the known protein (Acylphosphatase (SEQ ID NO:1440), organ-common type isozyme) at the end of the application. One or more alignments to one or more previously published protein sequences are given at the end of the application. A brief description of the relationship of the variant protein according to the present invention to each such aligned protein is as follows:

Comparison report between T99080_PEA_4_P8 (SEQ ID NO:1361) and ACYO_HUMAN_V1 (SEQ ID NO:1441):

1. An isolated chimeric polypeptide encoding for T99080_PEA_4_P8 (SEQ ID NO:1361), comprising a first amino acid sequence being at least 70%, optionally at least 80%, preferably at least 85%, more preferably at least 90% and most preferably at least 95% homologous to a polypeptide having the sequence M corresponding to amino acids 1-1 of T99080_PEA_4_P8 (SEQ ID NO:1361), and a second amino acid sequence being at least 90% homologous to QAE-GKKLGLVGWVQNTDRGTVQGQLQGPISKVRHM-QEWLETRGSPKSHIDKANFNNEKVILKLDYSDFQ IVK corresponding to amino acids 28-99 of ACYO_HUMAN_V1 (SEQ ID NO:1441), which also corresponds to amino acids 2-73 of T99080_PEA_4_P8 (SEQ ID NO:1361), wherein said first amino acid sequence and second amino acid sequence are contiguous and in a sequential order.

It should be noted that the known protein sequence (ACYO_HUMAN (SEQ ID NO:1440)) has one or more changes than the sequence given at the end of the application and named as being the amino acid sequence for ACYO_HUMAN_V1 (SEQ ID NO:1441). These changes were previously known to occur and are listed in the table below.

TABLE 729

Changes to ACYO_HUMAN_V1 (SEQ ID NO:1441)

| SNP position(s) or amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T99080_PEA_4_P8 (SEQ ID NO:1361) is encoded by the following transcript(s): T99080_PEA_4_T9 (SEQ ID NO:87), for which the sequence(s) is/are given at the end of the application. The coding portion of transcript T99080_PEA_4_T9 (SEQ ID NO:87) is shown in bold; this coding portion starts at position 162 and ends at position 380. The transcript also has the following SNPs as listed in Table 730 (given according to their position on the nucleotide sequence, with the alternative nucleic acid listed; the last column indicates whether the SNP is known or not; the presence of known SNPs in variant protein T99080_PEA_4_P8 (SEQ ID NO:1361) sequence provides support for the deduced sequence of this variant protein according to the present invention).

TABLE 730

| Nucleic acid SNPs | | |
|---|---|---|
| SNP position on nucleotide sequence | Alternative nucleic acid | Previously known SNP? |
| 465 | A -> G | Yes |
| 545 | A -> C | Yes |
| 584 | -> A | No |

Variant protein T99080_PEA_4_P9 (SEQ ID NO:1362) according to the present invention has an amino acid sequence as given at the end of the application; it is encoded by transcript(s) T99080_PEA_4_T10 (SEQ ID NO:88). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P9 (SEQ ID NO:1362) is encoded by the following transcript(s): T99080_PEA_4_T10 (SEQ ID NO:88), for which the sequence(s) is/are given at the end of the application. The coding portion of transcript T99080_PEA_4_T10 (SEQ ID NO:88) is shown in bold; this coding portion starts at position 1 and ends at position 261. The transcript also has the following SNPs as listed in Table 731 (given according to their position on the nucleotide sequence, with the alternative nucleic acid listed; the last column indicates whether the SNP is known or not; the presence of known SNPs in variant protein T99080_PEA_4_-P9 (SEQ ID NO:1362) sequence provides support for the deduced sequence of this variant protein according to the present invention).

TABLE 731

| Nucleic acid SNPs | | |
|---|---|---|
| SNP position on nucleotide sequence | Alternative nucleic acid | Previously known SNP? |
| 557 | A -> G | Yes |
| 637 | A -> C | Yes |
| 676 | -> A | No |

Variant protein T99080_PEA_4_P10 (SEQ ID NO:1363) according to the present invention has an amino acid sequence as given at the end of the application; it is encoded by transcript(s) T99080_PEA_4_T11 (SEQ ID NO:89). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P10 (SEQ ID NO:1363) is encoded by the following transcript(s): T99080_PEA_4_T11 (SEQ ID NO:89), for which the sequence(s) is/are given at the end of the application. The coding portion of transcript T99080_PEA_4_T11 (SEQ ID NO:89) is shown in bold; this coding portion starts at position 1 and ends at position 240. The transcript also has the following SNPs as listed in Table 732 (given according to their position on the nucleotide sequence, with the alternative nucleic acid listed; the last column indicates whether the SNP is known or not; the presence of known SNPs in variant protein T99080_PEA_4_P10 (SEQ ID NO:1363) sequence provides support for the deduced sequence of this variant protein according to the present invention).

TABLE 732

| Nucleic acid SNPs | | |
|---|---|---|
| SNP position on nucleotide sequence | Alternative nucleic acid | Previously known SNP? |
| 269 | G -> T | Yes |
| 592 | A -> G | Yes |
| 672 | A -> C | Yes |
| 711 | -> A | No |

Variant protein T99080_PEA_4_P12 (SEQ ID NO:1364) according to the present invention has an amino acid sequence as given at the end of the application; it is encoded by transcript(s) T99080_PEA_4_T14 (SEQ ID NO:91). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P12 (SEQ ID NO:1364) is encoded by the following transcript(s): T99080_PEA_4_T14 (SEQ ID NO:91), for which the sequence(s) is/are given at the end of the application. The coding portion of transcript T99080_PEA_4_T14 (SEQ ID NO:91) is shown in bold; this coding portion starts at position 1 and ends at position 282.

Variant protein T99080_PEA_4_P13 (SEQ ID NO:1365) according to the present invention has an amino acid sequence as given at the end of the application; it is encoded by transcript(s) T99080_PEA_4_T17 (SEQ ID NO:92). The location of the variant protein was determined according to results from a number of different software programs and analyses, including analyses from SignalP and other specialized programs. The variant protein is believed to be located as follows with regard to the cell: membrane. The protein localization is believed to be membrane because although it is a partial protein, because both trans-membrane region prediction programs predict that this protein has a trans-membrane region.

Variant protein T99080_PEA_4_P13 (SEQ ID NO:1365) is encoded by the following transcript(s): T99080_PEA_4_T17 (SEQ ID NO:92), for which the sequence(s) is/are given at the end of the application. The coding portion of transcript T99080_PEA_4_T17 (SEQ ID NO:92) is shown in bold; this coding portion starts at position 1 and ends at position 207.

Variant protein T99080_PEA_4_P14 (SEQ ID NO:1366) according to the present invention has an amino acid sequence as given at the end of the application; it is encoded by transcript(s) T99080_PEA_4_T18 (SEQ ID NO:93). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P14 (SEQ ID NO:1366) also has the following non-silent SNPs (Single Nucleotide Polymorphisms) as listed in Table 733, (given according to their position(s) on the amino acid sequence, with the alternative amino acid(s) listed; the last column indicates whether the SNP is known or not; the presence of known SNPs in variant protein T99080_PEA_4_P14 (SEQ ID NO:1366) sequence provides support for the deduced sequence of this variant protein according to the present invention).

TABLE 733

Amino acid mutations

| SNP position(s) on amino acid sequence | Alternative amino acid(s) | Previously known SNP? |
|---|---|---|
| 23 | A -> V | Yes |

Variant protein T99080_PEA_4_P14 (SEQ ID NO:1366) is encoded by the following transcript(s): T99080_PEA_4_T18 (SEQ ID NO:93), for which the sequence(s) is/are given at the end of the application. The coding portion of transcript T99080_PEA_4_T18 (SEQ ID NO:93) is shown in bold; this coding portion starts at position 226 and ends at position 480. The transcript also has the following SNPs as listed in Table 734 (given according to their position on the nucleotide sequence, with the alternative nucleic acid listed; the last column indicates whether the SNP is known or not; the presence of known SNPs in variant protein T99080_PEA_4_P14 (SEQ ID NO:1366) sequence provides support for the deduced sequence of this variant protein according to the present invention).

TABLE 734

Nucleic acid SNPs

| SNP position on nucleotide sequence | Alternative nucleic acid | Previously known SNP? |
|---|---|---|
| 293 | C -> T | Yes |
| 776 | A -> G | Yes |
| 856 | A -> C | Yes |
| 895 | -> A | No |

Variant protein T99080_PEA_4_P15 (SEQ ID NO:1367) according to the present invention has an amino acid sequence as given at the end of the application; it is encoded by transcript(s) T99080_PEA_4_T19 (SEQ ID NO:94). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P15 (SEQ ID NO:1367) also has the following non-silent SNPs (Single Nucleotide Polymorphisms) as listed in Table 735, (given according to their position(s) on the amino acid sequence, with the alternative amino acid(s) listed; the last column indicates whether the SNP is known or not; the presence of known SNPs invariant protein T99080_PEA_4_P15 (SEQ ID NO:1367) sequence provides support for the deduced sequence of this variant protein according to the present invention).

TABLE 735

Amino acid mutations

| SNP position(s) on amino acid sequence | Alternative amino acid(s) | Previously known SNP? |
|---|---|---|
| 23 | A -> V | Yes |

Variant protein T99080_PEA_4_P15 (SEQ ID NO:1367) is encoded by the following transcript(s): T99080_PEA_4_T19 (SEQ ID NO:94), for which the sequence(s) is/are given at the end of the application. The coding portion of transcript T99080_PEA_4_T19 (SEQ ID NO:94) is shown in bold; this coding portion starts at position 226 and ends at position 459. The transcript also has the following SNPs as listed in Table 736 (given according to their position on the nucleotide sequence, with the alternative nucleic acid listed; the last column indicates whether the SNP is known or not; the presence of known SNPs in variant protein T99080_PEA_4_P15 (SEQ ID NO:1367) sequence provides support for the deduced sequence of this variant protein according to the present invention).

TABLE 736

Nucleic acid SNPs

| SNP position on nucleotide sequence | Alternative nucleic acid | Previously known SNP? |
|---|---|---|
| 293 | C -> T | Yes |
| 488 | G -> T | Yes |
| 811 | A -> G | Yes |
| 891 | A -> C | Yes |
| 930 | -> A | No |

Variant protein T99080_PEA_4P16 (SEQ ID NO:1368) according to the present invention has an amino acid sequence as given at the end of the application; it is encoded by transcript(s) T99080_PEA_4_T20 (SEQ ID NO:95). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P16 (SEQ ID NO:1368) also has the following non-silent SNPs (Single Nucleotide Polymorphisms) as listed in Table 737, (given according to their position(s) on the amino acid sequence, with the alternative amino acid(s) listed; the last column indicates whether the SNP is known or not; the presence of known SNPs in variant protein T99080_PEA_4_P16 (SEQ ID NO:1368) sequence provides support for the deduced sequence of this variant protein according to the present invention).

TABLE 737

Amino acid mutations

| SNP position(s) on amino acid sequence | Alternative amino acid(s) | Previously known SNP? |
|---|---|---|
| 23 | A -> V | Yes |

Variant protein T99080_PEA_4_P16 (SEQ ID NO:1368) is encoded by the following transcript(s): T99080_PEA_4_T20 (SEQ ID NO:95), for which the sequence(s) is/are given at the end of the application. The coding portion of transcript T99080_PEA_4_T20 (SEQ ID NO:95) is shown in bold; this coding portion starts at position 226 and ends at position 501. The transcript also has the following SNPs as listed in Table 738 (given according to their position on the nucleotide sequence, with the alternative nucleic acid listed; the last column indicates whether the SNP is known or not; the presence of known SNPs in variant protein T99080_PEA_4_P16 (SEQ ID NO:1368) sequence provides support for the deduced sequence of this variant protein according to the present invention).

TABLE 738

Nucleic acid SNPs

| SNP position on nucleotide sequence | Alternative nucleic acid | Previously known SNP? |
|---|---|---|
| 293 | C -> T | Yes |

Variant protein T99080_PEA_4_P17 (SEQ ID NO:1369) according to the present invention has an amino acid sequence as given at the end of the application; it is encoded by transcript(s) T99080_PEA_4_T21 (SEQ ID NO:96). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T99080_PEA_4_P17 (SEQ ID NO:1369) also has the following non-silent SNPs (Single Nucleotide Polymorphisms) as listed in Table 739, (given according to their position(s) on the amino acid sequence, with the alternative amino acid(s) listed; the last column indicates whether the SNP is known or not; the presence of known SNPs in variant protein T99080_PEA_4_P17 (SEQ ID NO:1369) sequence provides support for the deduced sequence of this variant protein according to the present invention).

TABLE 739

Amino acid mutations

| SNP position(s) on amino acid sequence | Alternative amino acid(s) | Previously known SNP? |
|---|---|---|
| 23 | A -> V | Yes |

Variant protein T99080_PEA_4_P17 (SEQ ID NO:1369) is encoded by the following transcript(s): T99080_PEA_4_T21 (SEQ ID NO:96), for which the sequence(s) is/are given at the end of the application. The coding portion of transcript T99080_PEA_4_T21 (SEQ ID NO:96) is shown in bold; this coding portion starts at position 226 and ends at position 426. The transcript also has the following SNPs as listed in Table 740 (given according to their position on the nucleotide sequence, with the alternative nucleic acid listed; the last column indicates whether the SNP is known or not; the presence of known SNPs in variant protein T99080_PEA_4_P17 (SEQ ID NO:1369) sequence provides support for the deduced sequence of this variant protein according to the present invention).

TABLE 740

Nucleic acid SNPs

| SNP position on nucleotide sequence | Alternative nucleic acid | Previously known SNP? |
|---|---|---|
| 293 | C -> T | Yes |

As noted above, cluster T99080 features 11 segment(s), which were listed in Table 720 above and for which the sequence(s) are given at the end of the application. These segment(s) are portions of nucleic acid sequence(s) which are described herein separately because they are of particular interest. A description of each segment according to the present invention is now provided.

Segment cluster T99080_PEA_4 node 1 (SEQ ID NO:695) according to the present invention is supported by 5 libraries. The number of libraries was determined as previously described. This segment can be found in the following transcript(s): T99080_PEA_4_T0 (SEQ ID NO:83), T99080_PEA_4_T6 (SEQ ID NO:86), T99080_PEA_

4_T13 (SEQ ID NO:90), T99.080-PEA_4_T18 (SEQ ID NO:93), T99080_PEA_4_T19 (SEQ ID NO:94), T99080_PEA_4_T20 (SEQ ID NO:95) and T99080_PEA_4_T21 (SEQ ID NO:96). Table 741 below describes the starting and ending position of this segment on each transcript.

TABLE 741

Segment location on transcripts

| Transcript name | Segment starting position | Segment ending position |
| --- | --- | --- |
| T99080_PEA_4_T0 (SEQ ID NO:83) | 1 | 307 |
| T99080_PEA_4_T6 (SEQ ID NO:86) | 1 | 307 |
| T99080_PEA_4_T13 (SEQ ID NO:90) | 1 | 307 |
| T99080_PEA_4_T18 (SEQ ID NO:93) | 1 | 307 |
| T99080_PEA_4_T19 (SEQ ID NO:94) | 1 | 307 |
| T99080_PEA_4_T20 (SEQ ID NO:95) | 1 | 307 |
| T99080_PEA_4_T21 (SEQ ID NO:96) | 1 | 307 |

Segment cluster T99080_PEA_4_node_6 (SEQ ID NO:696) according to the present invention is supported by 3 libraries. The number of libraries was determined as previously described. This segment can be found in the following transcript(s): T99080_PEA_4_T17 (SEQ ID NO:92) and T99080_PEA_4_T21 (SEQ ID NO:96). Table 742 below describes the starting and ending position of this segment on each transcript.

TABLE 742

Segment location on transcripts

| Transcript name | Segment starting position | Segment ending position |
| --- | --- | --- |
| T99080_PEA_4_T17 (SEQ ID NO:92) | 181 | 627 |
| T99080_PEA_4_T21 (SEQ ID NO:96) | 400 | 846 |

Segment cluster T99080_PEA_4_node_11 (SEQ ID NO:697) according to the present invention is supported by 7 libraries. The number of libraries was determined as previously described. This segment can be found in the following transcript(s): T99080_PEA_4_T14 (SEQ ID NO:91) and T99080_PEA_4_T20 (SEQ ID NO:95). Table 743 below describes the starting and ending position of this segment on each transcript.

TABLE 743

Segment location on transcripts

| Transcript name | Segment starting position | Segment ending position |
| --- | --- | --- |
| T99080_PEA_4_T14 (SEQ ID NO:91) | 260 | 782 |
| T99080_PEA_4_T20 (SEQ ID NO:95) | 479 | 1001 |

Segment cluster T99080_PEA_4_node_19 (SEQ ID NO:698) according to the present invention is supported by 59 libraries. The number of libraries was determined as previously described. This segment can be found in the following transcript(s): T99080_PEA_4_T0 (SEQ ID NO:83), T99080_PEA_4_T2 (SEQ ID NO:84) and T99080_PEA_4_T4 (SEQ ID NO:85). Table 744 below describes the starting and ending position of this segment on each transcript.

TABLE 744

Segment location on transcripts

| Transcript name | Segment starting position | Segment ending position |
| --- | --- | --- |
| T99080_PEA_4_T0 (SEQ ID NO:83) | 449 | 1736 |
| T99080_PEA_4_T2 (SEQ ID NO:84) | 230 | 1517 |
| T99080_PEA_4_T4 (SEQ ID NO:85) | 78 | 1365 |

Segment cluster T99080_PEA_4_node_20 (SEQ ID NO:699) according to the present invention is supported by 98 libraries. The number of libraries was determined as previously described. This segment can be found in the following transcript(s): T99080_PEA_4_T0 (SEQ ID NO:83), T99080_PEA_4_T2 (SEQ ID NO:84), T99080_PEA_4_T4 (SEQ ID NO:85), T99080_PEA_4_T6 (SEQ ID NO:86), T99080_PEA_4_T9 (SEQ ID NO:87), T99080_PEA_4_T10 (SEQ ID NO:88), T99080_PEA_4_T11 (SEQ ID NO:89), T99080_PEA_4_T13 (SEQ ID NO:90), T99080_PEA_4_T18 (SEQ ID NO:93) and T99080_PEA_4_T19 (SEQ ID NO:94). Table 745 below describes the starting and ending position of this segment on each transcript.

TABLE 745

Segment location on transcripts

| Transcript name | Segment starting position | Segment ending position |
| --- | --- | --- |
| T99080_PEA_4_T0 (SEQ ID NO:83) | 1737 | 2175 |
| T99080_PEA_4_T2 (SEQ ID NO:84) | 1518 | 1956 |
| T99080_PEA_4_T4 (SEQ ID NO:85) | 1366 | 1804 |
| T99080_PEA_4_T6 (SEQ ID NO:86) | 400 | 838 |
| T99080_PEA_4_T9 (SEQ ID NO:87) | 168 | 606 |
| T99080_PEA_4_T10 (SEQ ID NO:88) | 260 | 698 |
| T99080_PEA_4_T11 (SEQ ID NO:89) | 295 | 733 |
| T99080_PEA_4_T13 (SEQ ID NO:90) | 308 | 746 |
| T99080_PEA_4_T18 (SEQ ID NO:93) | 479 | 917 |
| T99080_PEA_4_T19 (SEQ ID NO:94) | 514 | 952 |

According to an optional embodiment of the present invention, short segments related to the above cluster are also provided. These segments are up to about 120 bp in length, and so are included in a separate description.

Segment cluster T99080_PEA_4_node_3 (SEQ ID NO:700) according to the present invention is supported by 40 libraries. The number of libraries was determined as previously described. This segment can be found in the following transcript(s): T99080_PEA_4_T2 (SEQ ID NO:84), T99080_PEA_4_T9 (SEQ ID NO:87), T99080_PEA_4_T10 (SEQ ID NO:88), T99080_PEA_4_T11 (SEQ ID NO:89), T99080_PEA_4_T14 (SEQ ID NO:91) and T99080_PEA_4_T17 (SEQ ID NO:92). Table 746 below describes the starting and ending position of this segment on each transcript.

TABLE 746

Segment location on transcripts

| Transcript name | Segment starting position | Segment ending position |
| --- | --- | --- |
| T99080_PEA_4_T2 (SEQ ID NO:84) | 1 | 88 |
| T99080_PEA_4_T9 (SEQ ID NO:87) | 1 | 88 |

TABLE 746-continued

Segment location on transcripts

| Transcript name | Segment starting position | Segment ending position |
|---|---|---|
| T99080_PEA_4_T10 (SEQ ID NO:88) | 1 | 88 |
| T99080_PEA_4_T11 (SEQ ID NO:89) | 1 | 88 |
| T99080_PEA_4_T14 (SEQ ID NO:91) | 1 | 88 |
| T99080_PEA_4_T17 (SEQ ID NO:92) | 1 | 88 |

Segment cluster T99080_PEA_4_node_5 (SEQ ID NO:701) according to the present invention is supported by 57 libraries. The number of libraries was determined as previously described. This segment can be found in the following transcript(s): T99080_PEA_4_T0 (SEQ ID NO:83), T99080_PEA_4_T2 (SEQ ID NO:84), T99080_PEA_4_T6 (SEQ ID NO:86), T99080_PEA_4_T10 (SEQ ID NO:88), T99080_PEA_4_T11 (SEQ ID NO:89), T99080_PEA_4_T14 (SEQ ID NO:91), T99080_PEA_4_T17 (SEQ ID NO:92), T99080 PEA_4_T18 (SEQ ID NO:93), T99080_PEA_4_T19 (SEQ ID NO:94), T99080_PEA_4_T20 (SEQ ID NO:95) and T99080_PEA_4_T21 (SEQ ID NO:96). Table 747 below describes the starting and ending position of this segment on each transcript.

TABLE 747

Segment location on transcripts

| Transcript name | Segment starting position | Segment ending position |
|---|---|---|
| T99080_PEA_4_T0 (SEQ ID NO:83) | 308 | 399 |
| T99080_PEA_4_T2 (SEQ ID NO:84) | 89 | 180 |
| T99080_PEA_4_T6 (SEQ ID NO:86) | 308 | 399 |
| T99080_PEA_4_T10 (SEQ ID NO:88) | 89 | 180 |
| T99080_PEA_4_T11 (SEQ ID NO:89) | 89 | 180 |
| T99080_PEA_4_T14 (SEQ ID NO:91) | 89 | 180 |
| T99080_PEA_4_T17 (SEQ ID NO:92) | 89 | 180 |
| T99080_PEA_4_T18 (SEQ ID NO:93) | 308 | 399 |
| T99080_PEA_4_T19 (SEQ ID NO:94) | 308 | 399 |
| T99080_PEA_4_T20 (SEQ ID NO:95) | 308 | 399 |
| T99080_PEA_4_T21 (SEQ ID NO:96) | 308 | 399 |

Segment cluster T99080_PEA_4_node_8 (SEQ ID NO:702) according to the present invention is supported by 12 libraries. The number of libraries was determined as previously described. This segment can be found in the following transcript(s): T99080_PEA_4_T9 (SEQ ID NO:87), T99080_PEA_4_T10 (SEQ ID NO:88), T99080_PEA_4_T14 (SEQ ID NO:91), T99080_PEA_4_T18 (SEQ ID NO:93) and T99080_PEA_4_T20 (SEQ ID NO:95). Table 748 below describes the starting and ending position of this segment on each transcript.

TABLE 748

Segment location on transcripts

| Transcript name | Segment starting position | Segment ending position |
|---|---|---|
| T99080_PEA_4_T9 (SEQ ID NO:87) | 89 | 167 |
| T99080_PEA_4_T10 (SEQ ID NO:88) | 181 | 259 |
| T99080_PEA_4_T14 (SEQ ID NO:91) | 181 | 259 |
| T99080_PEA_4_T18 (SEQ ID NO:93) | 400 | 478 |
| T99080_PEA_4_T20 (SEQ ID NO:95) | 400 | 478 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 749.

TABLE 749

Oligonucleotides related to this segment

| Oligonucleotide name | Overexpressed in cancers | Chip reference |
|---|---|---|
| T99080_0_0_58896 (SEQ ID NO:233) | lung malignant tumors | LUN |

Segment cluster T99080_PEA_4_node_13 (SEQ ID NO:703) according to the present invention is supported by 2 libraries. The number of libraries was determined as previously described. This segment can be found in the following transcript(s): T99080_PEA_4_T4 (SEQ ID NO:85). Table 750 below describes the starting and ending position of this segment on each transcript.

TABLE 750

Segment location on transcripts

| Transcript name | Segment starting position | Segment ending position |
|---|---|---|
| T99080_PEA_4_T4 (SEQ ID NO:85) | 1 | 77 |

Segment cluster T99080_PEA_4_node_15 (SEQ ID NO:704) according to the present invention is supported by 6 libraries. The number of libraries was determined as previously described. This segment can be found in the following transcript(s): T99080_PEA_4_T11 (SEQ ID NO:89) and T99080_PEA_4_T19 (SEQ ID NO:94). Table 751 below describes the starting and ending position of this segment on each transcript.

TABLE 751

Segment location on transcripts

| Transcript name | Segment starting position | Segment ending position |
|---|---|---|
| T99080_PEA_4_T11 (SEQ ID NO:89) | 181 | 294 |
| T99080_PEA_4_T19 (SEQ ID NO:94) | 400 | 513 |

Segment cluster T99080_PEA_4_node_18 (SEQ ID NO:705) according to the present invention is supported by 5 libraries. The number of libraries was determined as previously described. This segment can be found in the following transcript(s): T99080_PEA_4_T0 (SEQ ID NO:83) and T99080_PEA_4_T2 (SEQ ID NO:84). Table 752 below describes the starting and ending position of this segment on each transcript.

TABLE 752

Segment location on transcripts

| Transcript name | Segment starting position | Segment ending position |
|---|---|---|
| T99080_PEA_4_T0 (SEQ ID NO:83) | 400 | 448 |
| T99080_PEA_4_T2 (SEQ ID NO:84) | 181 | 229 |

Variant protein alignment to the previously known protein:

Sequence name: ACYO_HUMAN_V1 (SEQ ID NO:1441)

Sequence documentation:

Alignment of: T99080_PEA_4_P5 (SEQ ID NO:1360) x ACYO_HUMAN_V1 (SEQ ID NO:1441) . . .

Alignment segment 1/1:

| | |
|---|---|
| Quality: 973.00 | Escore: 0 |
| Matching length: 99 | Total length: 99 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 31  MAEGNTLISVDYEIFGKVQGVFFRKHTQAEGKKLGLVGWVQNTDRGTVQG   80
     ||||||||||||||||||||||||||||||||||||||||||||||||||
  1  MAEGNTLISVDYEIFGKVQGVFFRKHTQAEGKKLGLVGWVQNTDRGTVQG   50

81  QLQGPISKVRHMQEWLETRGSPKSHIDKANFNNEKVILKLDYSDFQIVK   129
     ||||||||||||||||||||||||||||||||||||||||||||||||
 51  QLQGPISKVRHMQEWLETRGSPKSHIDKANFNNEKVILKLDYSDFQIVK    99
```

Sequence name: ACYO_HUMAN_V1 (SEQ ID NO:1441)

Sequence documentation:

Alignment of: T99080_PEA_4_P8 (SEQ ID NO:1361) x ACYO_HUMAN_V1 (SEQ ID NO:1441) . . .

Alignment segment 1/1:

| | |
|---|---|
| Quality: 711.00 | Escore: 0 |
| Matching length: 72 | Total length: 72 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  2  QAEGKKLGLVGWVQNTDRGTVQGQLQGPISKVRHMQEWLETRGSPKSHID  51
     |||||||||||||||||||||||||||||||||||||||||||||||||
 28  QAEGKKLGLVGWVQNTDRGTVQGQLQGPISKVRHMQEWLETRGSPKSHID  77

52  KANFNNEKVILKLDYSDFQIVK                              73
     ||||||||||||||||||||||
 78  KANFNNEKVILKLDYSDFQIVK                              99
```

Description for Cluster T08446

Cluster T08446 features 2 transcript(s) and 36 segment(s) of interest, the names for which are given in Tables 753 and 754, respectively, the sequences themselves are given at the end of the application. The selected protein variants are given in table 755.

TABLE 753

Transcripts of interest

| Transcript Name | Sequence ID No. |
|---|---|
| T08446_PEA_1_T2 | 97 |
| T08446_PEA_1_T22 | 98 |

TABLE 754

Segments of interest

| Segment Name | Sequence ID No. |
|---|---|
| T08446_PEA_1_node_2 | 706 |
| T08446_PEA_1_node_9 | 707 |
| T08446_PEA_1_node_15 | 708 |
| T08446_PEA_1_node_17 | 709 |
| T08446_PEA_1_node_25 | 710 |
| T08446_PEA_1_node_29 | 711 |
| T08446_PEA_1_node_38 | 712 |

TABLE 754-continued

Segments of interest

| Segment Name | Sequence ID No. |
|---|---|
| T08446_PEA_1_node_43 | 713 |
| T08446_PEA_1_node_51 | 714 |
| T08446_PEA_1_node_52 | 715 |
| T08446_PEA_1_node_55 | 716 |
| T08446_PEA_1_node_57 | 717 |
| T08446_PEA_1_node_59 | 718 |
| T08446_PEA_1_node_62 | 719 |
| T08446_PEA_1_node_63 | 720 |
| T08446_PEA_1_node_3 | 721 |
| T08446_PEA_1_node_5 | 722 |
| T08446_PEA_1_node_7 | 723 |

TABLE 754-continued

Segments of interest

| Segment Name | Sequence ID No. |
|---|---|
| T08446_PEA_1_node_12 | 724 |
| T08446_PEA_1_node_13 | 725 |
| T08446_PEA_1_node_19 | 726 |
| T08446_PEA_1_node_21 | 727 |
| T08446_PEA_1_node_23 | 728 |
| T08446_PEA_1_node_27 | 729 |
| T08446_PEA_1_node_32 | 730 |
| T08446_PEA_1_node_34 | 731 |
| T08446_PEA_1_node_45 | 732 |
| T08446_PEA_1_node_46 | 733 |
| T08446_PEA_1_node_48 | 734 |
| T08446_PEA_1_node_54 | 735 |
| T08446_PEA_1_node_58 | 736 |
| T08446_PEA_1_node_60 | 737 |
| T08446_PEA_1_node_61 | 738 |
| T08446_PEA_1_node_64 | 739 |
| T08446_PEA_1_node_65 | 740 |
| T08446_PEA_1_node_66 | 741 |

TABLE 755

Proteins of interest

| Protein Name | Sequence ID No. | Corresponding Transcript(s) |
|---|---|---|
| T08446_PEA_1_P18 | 1370 | T08446_PEA_1_T2 (SEQ ID NO:97) |
| T08446_PEA_1_P19 | 1371 | T08446_PEA_1_T22 (SEQ ID NO:98) |

These sequences are variants of the known protein Sorting nexin 26 (SwissProt accession identifier SNXQHUMAN), SEQ ID NO:1442, referred to herein as the previously known protein.

Protein Sorting nexin 26 (SEQ ID NO:1442) is known or believed to have the following function(s): May be involved in several stages of intracellular trafficking (By similarity). The sequence for protein Sorting nexin 26 is given at the end of the application, as "Sorting nexin 26 amino acid sequence".

The following GO Annotation(s) apply to the previously known protein. The following annotation(s) were found: intracellular protein traffic, which are annotation(s) related to Biological Process; and protein transporter, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

As noted above, cluster T08446 features 2 transcript(s), which were listed in Table 753 above. These transcript(s) encode for protein(s) which are variant(s) of protein Sorting nexin 26 (SEQ ID NO:1442). A description of each variant protein according to the present invention is now provided.

Variant protein T08446_PEA_1_P18 (SEQ ID NO:1370) according to the present invention has an amino acid sequence as given at the end of the application; it is encoded by transcript(s) T08446_PEA_1_T2 (SEQ ID NO:97). An alignment is given to the known protein (Sorting nexin 26 (SEQ ID NO:1442)) at the end of the application. One or more alignments to one or more previously published protein sequences are given at the end of the application. A brief description of the relationship of the variant protein according to the present invention to each such aligned protein is as follows:

Comparison report between T08446_PEA_1_P18 (SEQ ID NO:1370) and SNXQ_HUMAN (SEQ ID NO:1442):

1. An isolated chimeric polypeptide encoding for T08446_PEA_1_P18 (SEQ ID NO:1370), comprising a first amino acid sequence being at least 90% homologous to MLSLSLCSHLWGPLILSALQARSTDSLDGPGEGSVQ-PLPTAGGPSVKGKPGKRLSAPRGPFPRLADCAHFH YENVDFGHIQLLLSPDREGPSLSGENELVFGVQV-TCQGRSWPVLRSYDDFRSLDAHLHRCIFDRRFS-CLPEL PPPPEGARAAQMLVPLLLQYLETLS-GLVDSNLNCGPVLTWME corresponding to amino acids 1-185 of SNXQ_HUMAN (SEQ ID NO:1442), which also corresponds to amino acids 1-185 of T08446_PEA_1_P18 (SEQ ID NO:1370), and a second amino acid sequence being at least 70%, optionally at least 80%, preferably at least 85%, more preferably at least 90% and most preferably at least 95% homologous to a polypeptide having the sequence LDNH-GRRLLLSEEASLNIPAVAAAHVIKRYTAQAPDEL-SFEVGDIVSVIDMPPTEDRSWWRGKRGFQVGFF PSECVELFTERPGPGLKADADGPPCGIPAPQGISSLT-SAVPRPRGKLAGLLRTFMRSRPSRQRLRQRGILRQR VFGCDLGEHLSNSGQDVPQVLRCCSEFIEAHGV-VDGIYRLSGVSSNIQRLRHEFDSERIPELSGPAFL-QDIHS VSSLCKLYFRELPNPLLTYQLYGKF-SEAMSVPGEEERLVRVHDVIQQLPPPHYRTLEYLLR-= HLARMARHSA NTSMHARNLAIVWAPNLLRSME-LESVGMGGAAAFREVRVQSVVVEFLLTH-VDVLFSDTFTSAGLDPAGR CLLPRPKSLAGSCPSTR-LLTLEEAQARTQGRLGTPTEPTTPKAPASPAERRKGE-RGEKQRKPGGSSWKTFF ALGRGPSVPRKKPLPWLG-GTRAPPQPSGSRPDTVTLRSAKSEESLSSQASG-AGLQRLHRLRRPHSSSDAFPV GPAPAGSCESLSS-SSSSESSSSESSSSSSESSAAGLGALSGSPSHRTSA-WLDDGDELDFSPPRCLEGLRGLDFD PLTFRCSSPT-PGDPAPPASPAPPAPASAFPPRVTPQAISPRGPTSPAS-PAALDISEPLAVSVPPAVLELLGAGG APASATPTPAL-SPGRSLRPHLIPLLLRGAEAPLTDACQQEMCSKLR-GAQGPLGPDMESPLPPPPLSLLRPGG APPPPPKNPAR-LMALALAERAQQVAEQQSQQECGGTPPASQSPFH-RSLSLEVGGEPLGTSGSGPPPNSLAH PGAWVPGPP-PYLPRQQSDGSLLRSQRPMGTSRRGLRGPAQVSAQ-LRAGGGGRDAPEAAAQSPCSVPSQVP TPGFFSPA-PRECLPPFLGVPKPGLYPLGPPSFQPSSPAPVWRSSL-GPPAPLDRGENLYYEIGASEGSPYSGPTR SWSP-FRSMPPDRLNASYGMLGQSPPLHRSPDFLLSYPPA-PSCFPPDHLGYSAPQHPARRPTPPEPLYVNLAL-GPRGPSPASSSSSSPPAHPRSRSDPGPPVPRLPQKQ-RAPWGPRTTHRVPGPWGPPEPLLLYRAAPPAYGRGG ELHRGSLYRNGGQRGEGAGPPPPYPTPSWSLHSEG-QTRSYC (SEQ ID NO:1733) corresponding to amino acids 186-1305 of T08446_PEA_1_P18 (SEQ ID NO:1370), wherein said first amino acid sequence and second amino acid sequence are contiguous and in a sequential order.

2. An isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence LDNHGRRLLLSEEASLNIPAVAAAH-VIKRYTAQAPDELSFEVGDIVSVID-MPPTEDRSWWRGKRGFQVGFF PSECVELFTERPG-PGLKADADGPPCGIPAPQGISSLTSAVPRPRGKLAGLL-RTFMRSRPSRQRLRQRGILRQR VFGCDLGEHLSNS-GQDVPQVLRCCSEFIEAHGVVDGIYRLS- GVSSNIQRLRHEFDSERIPELSGPAFLQDIHS VSSLCK-LYFRELPNPLLTYQLYGKFSEAMSVPGEEERLVRVHD-VIQQLPPPHYRTLEYLLRHLARMARHSA NTSM-HARNLAIWAPNLLRSMELESVGMGGAAAFREVRV-QSVVVEFLLTHVDVLFSDTFTSAGLDPAGR CLL-PRPKSLAGSCPSTRLLTLEEAQARTQGRLGTPTEPTT-PKAPASPAERRKGERGEKQRKPGGSSWKTFF ALGRGPSVPRKKPLPWLGGTRAPPQPSGSRPDTVT-LRSAKSEESLSSQASGAGLQRLHRLRRPHSSSDAFPV GPAPAGSCESLSSSSSSESSSSESSSSSSESSAAGL-GALSGSPSHRTSAWLDDGDELDFSPPRC-LEGLRGLDFD PLTFRCSSPTPGDPAPPASPAPPAPASA-FPPRVTPQAISPRGPTSPASPAALDIS-EPLAVSVPPAVLELLGAGG APASATPTPALSPGRSLRPHLIPLLLR-GAEAPLTDACQQEMCSKLRGAQGPLGP-MESPLPPPPLSLLRPGG APPPPPKNPARLMALALAER-AQQVAEQQSQQECGGTPPASQSPFHRSLSLEVG-GEPLGTSGSGPPPNSLAH PGAWVPGPPPYLPRQQS-DGSLLRSQRPMGTSRRGLRGPAQVSAQL-RAGGGGRDAPEAAAQSPCSVPSQVP TPGFFSPAPRE-CLPPFLGVPKPGLYPLGPPSFQPSSPAPVWRSSLGPPA-PLDRGENLYYEIGASEGSPYSGPTR SWSPFRSMPP-DRLNASYGMLGQSPPLHRSPDFLLSYPPAPSCFP-PDHLGYSAPQHPARRPTPPEPLYVNLAL GPRGPS-PASSSSSSPPAHPRSRSDPGPPVPRLPQKQRAPWGPR-TPHRVPGPWGPPEPLLLYRAAPPAYGRGG ELHRGSLYRNGGQRGEGAGPPPPYPTPSWSLH-SEGQTRSYC (SEQ ID NO:1733) in T08446_PEA__1_P18 (SEQ ID NO:1370).

Comparison report between T08446_PEA__1_P18 (SEQ ID NO:1370) and Q9NT23 (SEQ ID NO:1443) (SEQ ID NO:1443):

1. An isolated chimeric polypeptide encoding for T08446_PEA__1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-SALQARSTDSLDGPGEGSVQPLPTAGGPSVKGKP-GKRLSAPRGPFPRLADCAHFH YENVDFGHIQLLLSP-DREGPSLSGENELVFGVQVTCQGRSWPVLRSYDDF-RSLDAHLHRCIFDRRFSCLPEL PPPPEGARAAQMLV-PLLLQYLETLSGLVDSNLNCGPVLTWMELDNHG-RRLLLSEEASLNIPAVAAAHVIK RYTAQAPDELSFE-VGDIVSVIDMPPTEDRSWWRGKRGFQVGFFPSE-CVELFTERPGPGLKADADGPPCGIP APQGISSLT-SAVPRPRGKLAGLLRTFMRSRPSRQRLRQRGILRQRV-FGCDLGEHLSNSGQDVPQVLRCCSEF IEAHGVVDG-IYRLSGVSSNIQRLRHEFDSERIPELSG-PAFLQDIHSVSSLCKLYFRELPNPLLTYQLYGKFSEA MSVPGEEERLVRV (SEQ ID NO: 1734) corresponding to amino acids 1-443 of T08446_PEA__1_P18 (SEQ ID NO:1370), a second amino acid sequence being at least 90% homologous to HDVIQQLPPPHYRTLEYLLRHLARM-ARHSANTSMHARNLAIVWAPNLLRSME-LESVGMGGAAAFREVRV QSVVVEFLLTHVDVLFS-DTFTSAGLDPAGRCLLPRPKSLAGSCPSTRLLTLEEAQ-ARTQGRLGTPTEPTTPK APASPAERRKGERGEKQRK-PGGSSWKTFFALGRGPSVPRKKPLPWLG-GTRAPPQPSGSRPDTVTLRSAKSE ESLSSQAS-GAGLQRLHRLRRPHSSSDAFPVGPAPAGSCESLSSSSS-SESSSSESSSSSSESSAAGLGALSGSPS HRTSAWLD-DGDELDFSPPRCLEGLRGLDFDPLTFRCSSPTPG-DPAPPASPAPPAPASAFPPRVTPQAISPRGP TSPASPAALDISEPLAVSVPPAVLELLGAGGAPASAT-PTPALSPGRSLRPHLIPLLLRGAEAPLTDACQQEMC SKLRGAQGPLGPDMESPLPPPPLSLLRPGGAPPPP-PKNPARLMALALAERAQQVAEQQSQQECGGTPPASQ SPFHRSLSLEVGGEPLGTSGSGPPPNSLAHPGAWVP-GPPPYLPRQQSDGSLLRSQRPMGTSRRGLRGPAQV SAQLRAGGGGRDAPEAAAQSPCSVPSQVPTPGF-FSPAPRECLPPFLGVPKPGLYPLGPPSFQPSSPAP-VWRS SLGPPAPLDRGENLYYEIGASEGSPYSG corresponding to amino acids 1-674 of Q9NT23 (SEQ ID NO:1443), which also corresponds to amino acids 444-1117 of T08446_PEA__1_P18 (SEQ ID NO:1370), a bridging amino acid P corresponding to amino acid 1118 of T08446_PEA__1_P18 (SEQ ID NO:1370), and a third amino acid sequence being at least 90% homologous to TRSWSP-FRSMPPDRLNASYGMLGQSPPLHRSPDFLLSYPP-APSCFPPDHLGYSAPQHPARRPTPPEPLYVNL ALG-PRGPSPASSSSSSPPAHPRSRSDPGPPVPRLPQKQRAP-WGPRTPHRVPGPWGPPEPLLLYRAAPPAYGR GGEL-HRGSLYRNGGQRGEGAGPPPPYPTPSWS-LHSEGQTRSYC corresponding to amino acids 676-862 of Q9NT23 (SEQ ID NO:1443), which also corresponds to amino acids 1119-1305 of T08446_PEA__1_P18 (SEQ ID NO:1370), wherein said first amino acid sequence, second amino acid sequence, bridging amino acid and third amino acid sequence are contiguous and in a sequential order.

2. An isolated polypeptide encoding for a head of T08446_PEA__1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-SLDGPGEGSVQPLPTAGGPSVKGKPGKRLSAPRG-PFPRLADCAHFH YENVDFGHIQLLLSPDREGPSLS-GENELVFGVQVTCQGRSWPVLRSYDDFRSLDAHLH-RCIFDRRFSCLPEL PPPPEGARAAQMLVPLLLQYLE-TLSGLVDSNLNCGPVLTWMELDNHGRRLLLSEE-ASLNIPAVAAAHVIK RYTAQAPDELSFEVGDIVSVID-MPPTEDRSWWRGKRGFQVGFFPSECVELFTERPGP-GLKADADGPPCGIP APQGISSLTSAVPRPRGKLAGLL-RTFMRSRPSRQRLRQRGILRQRVFGCDLGEHLSNS-GQDVPQVLRCCSEF IEAHGVVDGIYRLSGVSSNIQR-LRHEFDSERIPELSGPAFLQDIHSVSSLCKLYFRELP-NPLLTYQLYGKFSEA MSVPGEEERLVRV (SEQ ID NO:1734) of T08446_PEA__1_1P18 (SEQ ID NO:1370).

Comparison report between T08446_PEA__1_P18 (SEQ ID NO:1370) and Q96CP3 (SEQ ID NO:1444) (SEQ ID NO:1444):

1. An isolated chimeric polypeptide encoding for T08446_PEA__1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-SALQARSTDSLDGPGEGSVQPLPTAGGPSVKGKPG-KRLSAPRGPFPRLADCAHFH YENVDFGHIQLLLSP-DREGPSLSGENELVFGVQVTCQGRSWPVLRSYDDF-RSLDAHLHRCIFDRRFSCLPEL PPPPEGARAAQMLV-PLLLQYLETLSGLVDSNLNCGPVLTWMELDNHGR-RLLLSEEASLNIPAVAAAHVIK RYTAQAPDELSFE-VGDIVSVIDMPPTEDRSWWRGKRGFQVGFFPSEC-VELFTERPGPGLKADADGPPCGIP APQGISSLT-SAVPRPRGKLAGLLRTFMRSRPSRQRLRQRGILRQ-RVFGCDLGEHLSNSGQDVPQVLRCCSEF IEAHGV-VDGIYRLSGVSSNIQRLRHEFDSERIPELSGPAFL-QDIHSVSSLCKLYFRELPNPLLTYQLYGKFSEA MSVP-GEEERLVRVHDVIQQLPPPHYRTLEYLLRHLAR-MARHSANTSMHARNLAIVWAPNLLRSMELESV GMGGAAAFREVRVQSVVVEFLLTHVDV- LFSDTFTSAGLDPAGRCLLPRPKSLAGSCPSTRLLT-
LEEAQART QGRLGTPTEPTTPKAPASPAER-
RKGERGEKQRKPGGSSWKTFFALGRGPSVPRKKPL-
PWLGGTRAPPQPSG SRPDTVTLRSAKSEESLSSQAS-
GAGLQRLHRLRRPHSSSDAFPVGPAPAGSCESLSSS-
SSSESSSSESSSSSSES SAAGLGALSGPSHRTSAWL-
DDGDELDFSPPRCLEGLRGLDFDPLTFRCSSPTPG-
DPAPPASPAPPAPASAF PPRVTPQAISPRGPTSPAS-
PAALDISEPLAVSVPPAVLELLGAGGA-
PASATPTPALSPGRSLRPHLIPLLLRGA EAPLTDAC-
QQEMCSKLRGAQGPLGPDMESPLPPP-
PLSLLRPGGAPPPPPKNPAR-
LMALALAERAQQVAEQ QSQQECGGTPPASQSPF-
HRSLSLEVGGEPLGTSGSGPPPNSLAHP-
GAWVPGPPPYLPRQQSDGSLLRSQRPM GTSRRG corresponding to amino acids 1-1010 of T08446_PEA_1_P18 (SEQ ID NO:1370), and a second amino acid sequence being at least 90% homologous to LRGPAQVSAQL-
RAGGGGRDAPEAAAQSPCSVPSQVPTPG-
FFSPAPRECLPPFLGVPKPGLYPLGPPSFQPSS
PAPVWRSSLGPPAPLDRGENLYYEIGAS-
EGSPYSGPTRSWSPFRSMPPDRLNASYG-
MLGQSPPLHRSPDFLL SYPPAPSCFPPDHLGYSAPQH-
PARRPTPPEPLYVNLALGPRGPSPASSSSSSPPAHPRSR-
SDPGPPVPRLPQKQ RAPWGPRTPHRVPGPWGPPEP-
LLLYRAAPPAYGRGGELHRGSLYRNG-
GQRGEGAGPPPPYPTPSWSLHSE GQTRSYC corresponding to amino acids 1-295 of Q96CP3 (SEQ ID NO:1444), which also corresponds to amino acids 1011-1305 of T08446_PEA_1_P18 (SEQ ID NO:1370), wherein said first amino acid sequence and second amino acid sequence are contiguous and in a sequential order.

2. An isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-
SLDGPGEGSVQPLPTAGGPSVKGKPGKRLSAPR-
GPFPRLADCAHFH YENVDFGHIQLLLSPDREGPSLS-
GENELVFGVQVTCQGRSWPVLRSYDD-
FRSLDAHLHRCIFDRRFSCLPEL PPPPEGARAAQMLV-
PLLLQYLETLSGLVDSNLNCGPVLTW-
MELDNHGRRLLLSEEASLNIPAVAAAHVIK
RYTAQAPDELSFEVGDIVSVIDMPPT-
EDRSWWRGKRGFQVGFFPSECVELFTER-
PGPGLKADADGPPCGIP APQGISSLTSAVPRPRGKLA-
GLLRTFMRSRPSRQRLRQRGILRQRVFGCDLGEHLSN-
SGQDVPQVLRCCSEF IEAHGVVDGIYRLSGVSS-
NIQRLRHEFDSERIPELSGPAFLQDIHSVSSLCKL-
YFRELPNPLLTYQLYGKFSEA MSVPGEEERLVRVHD-
VIQQLPPPHYRTLEYLLRHLARMARHSANTSMH-
ARNLAIVWAPNLLRSMELESV GMGGAAAFREVR-
VQSVVVEFLLTHVDVLFSDTFTSAGLDPAGRCLLP-
RPKSLAGSCPSTRLLTLEEAQART QGRLGTPTEPTTP-
KAPASPAERRKGERGEKQRKPGGSSWKTFFALG-
RGPSVPRKKPLPWLGGTRAPPQPSG SRPDTVTLR-
SAKSEESLSSQASGAGLQRLHRLR-
RPHSSSDAFPVGPAPAG-
SCESLSSSSSSESSSSESSSSSES
SAAGLGALSGSPSHRTSAWLDDGDELDF-
SPPRCLEGLRGLDFDPLTFRCSSPTPGD-
PAPPASPAPPAPASAF PPRVTPQAISPRGPTSPASPAAL-
DISEPLAVSVPPAVLELLGAGGAPASATPTALSPGRS-
LRPHLIPLLLRGA EAPLTDACQQEMCSKLRGAQG-
PLGPDMESPLPPPPLSLLRPGGAPPPPP-
KNPARLMALALAERAQQVAEQ QSQQECGGTPPAS-
QSPFHRSLSLEVGGEPLGTSGSGPPPNSLAHPGAWVP-
GPPPYLPRQQSDGSLLRSQRPM GTSRRG of T08446_PEA_1_P18 (SEQ ID NO:1370).

Comparison report between T08446_PEA_1_P18 (SEQ ID NO:1370) and BAC86902 (SEQ ID NO: 1445):

1. An isolated chimeric polypeptide encoding for T08446_PEA_1_P18 (SEQ ID NO:1370), comprising a first amino acid sequence being at least 70%, optionally at least 80%, preferably at least 85%, more preferably at least 90% and most preferably at least 95% homologous to a polypeptide having the sequence MLSLSLCSHLWGPLIL-
SALQARSTDSLDGPGEGSVQPLPTAG-
GPSVKGKPGKRLSAPRGPFPRLADCAHFH
YENVDFGHIQLLLSPDREGPSLS-
GENELVFGVQVTCQGRSWPVLRSYD-
DFRSLDAHLHRCIFDRRFSCLPEL PPPPEGARAAQ corresponding to amino acids 1-154 of T08446_PEA_1_P18 (SEQ ID NO:1370), a second amino acid sequence being at least 90% homologous to MLVPLLLQYLETLSGLVD-
SNLNCGPVLTWMELDNHGRRLLLSEEA-
SLNIPAVAAAHVIKRYTAQAPDELS FEVGDIVSVID-
MPPTEDRSWWRGKRGFQVGFFPSECVELFTERPGPG-
LKADADGPPCGIPAPQGISSLTSAV PRPRGKLAGLL-
RTFMRSRPSRQRLRQRGILRQRVF-
GCDLGEHLSNSGQDVPQVLRCCSEFIEAHGVVDGIY
RLSGVSSNIQRLRHEFDSERIPELSG-
PAFLQDIHSVSSLCKLYFRELPN-
PLLTYQLYGKFSEAMSVPGEEERL VRVHDVIQQLPP-
PHYRTLEYLLRHLARMARHSANTSMHARNLAIVWA-
PNLLRSMELESVGMGGAAAFRE VRVQSVVVE-
FLLTHVDVLFSDTFTSAGLDPAGRCLL-
PRPKSLAGSCPSTRLLTLEEAQARTQGRLGTPTEPT
TPKAPASPAERRKGERGEKQRKPGGSS-
WKTFFALGRGPSVPRKKPLPWLGGTRAP-
PQPSGSRPDTVTLRSA KSEESLSSQASGAGLQRLHR-
LRRPHSSSDAFPVGPAPAGSCESLSSSSSSESSSSESSSS-
SSESSAAGLGALSG SPSHRTSAWLDDGDELDFSP-
PRCLEGLRGLDFDPLTFRCSSPTPGDPA-
PPASPAPPAPASAFPPRVTPQAISP RGPTSPASPAALD-
ISEPLAVSVPPAVLELLGAGGAPASATPTPALSPGRSL-
RPHLIPLLLRGAEAPLTDACQQ EMCSKLRGAQGPLG-
PDMESPLPPPPLSLLRPGGAPPPPPKN-
PARLMALALAERAQQVAEQQSQQECGGTPP
ASQSPFHRSLSLEVGGEPLGTSGSGPPP-
NSLAHPGAWVPGPPPYLPRQQSDGSLLR-
SQRPMGTSRRGLRGP A corresponding to amino acids 1-861 of BAC86902 (SEQ ID NO:1445), which also corresponds to amino acids 155-1015 of T08446_PEA_1_P18 (SEQ ID NO:1370), a third amino acid sequence being at least 70%, optionally at least 80%, preferably at least 85%, more preferably at least 90% and most preferably at least 95% homologous to a polypeptide having the sequence QVSAQL-
RAGGGGRDAPEAAAQSPCSVPS corresponding to amino acids 1016-1043 of T08446_PEA_1_P18 (SEQ ID NO:1370), a fourth amino acid sequence being at least 90% homologous to QVPTPGFFSPAPRECLPPFLGVPKPGLY-
PLGPPSFQPSSPAPVWRSSLGPPAPLDRGENLYY-
EIGASEGSPYS GPTRSWSPFRSMPPDRLNASYGM-
LGQSPPLHRSPDFLLSYPPAPSCFPPDHLGYS corresponding to amino acids 862-989 of BAC86902 (SEQ ID NO:1445), which also corresponds to amino acids 1044-1171 of T08446_PEA_1_P18 (SEQ ID NO:1370), and a fifth amino acid sequence being at least 70%, optionally at least 80%, preferably at least 85%, more preferably at least 90% and most preferably at least 95% homologous to a polypeptide having the sequence APQHPARRPTPPEPLYVNLAL- GPRGPSPASSSSSSPPAHPRSRSDPGPPVPRLPQKQRA-PWGPRTPHRVPGP WGPPEPLLLYRAAPPAYGRGGEL-HRGSLYRNGGQRGEGAGPPPPYPTPSWSLHSEG-QTRSYC corresponding to amino acids 1172-1305 of T08446_PEA_1_P18 (SEQ ID NO:1370), wherein said first amino acid sequence, second amino acid sequence, third amino acid sequence, fourth amino acid sequence and fifth amino acid sequence are contiguous and in a sequential order.

2. An isolated polypeptide encoding for a head of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence MLSLSLCSHLWGPLILSALQARSTD-SLDGPGEGSVQPLPTAGGPSVKGKPGKRLSAPRG-PFPRLADCAHFH YENVDFGHIQLLLSPDREGPSLS-GENELVFGVQVTCQGRSWPVLRSYDDFRSLDAH-LHRCIFDRRFSCLPEL PPPPEGARAAQ of T08446_PEA_1_P18 (SEQ ID NO:1370).

3. An isolated polypeptide encoding for an edge portion of T08446_PEA_1_P18 (SEQ ID NO:1370), comprising an amino acid sequence being at least 70%, optionally at least about 80%, preferably at least about 85%, more preferably at least about 90% and most preferably at least about 95% homologous to the sequence encoding for QVSAQL-RAGGGGRDAPEAAAQSPCSVPS, corresponding to T08446_PEA_1_P18 (SEQ ID NO:1370).

4. An isolated polypeptide encoding for a tail of T08446_PEA_1_P18 (SEQ ID NO:1370), comprising a polypeptide being at least 70%, optionally at least about 80%, preferably at least about 85%, more preferably at least about 90% and most preferably at least about 95% homologous to the sequence APQHPARRPTPPEPLYVNLALGPRGPS-PASSSSSSPPAHPRSRSDPGPPVPRLPQKQRAPWGP-RTPHRVPGP WGPPEPLLLYRAAPPAYGRGGELHRG-SLYRNGGQRGEGAGPPPPYPTPSWSLHSEGQTRSYC in T08446_PEA_1_P18 (SEQ ID NO:1370).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T08446_PEA_1_P18 (SEQ ID NO:1370) also has the following non-silent SNPs (Single Nucleotide Polymorphisms) as listed in Table 756, (given according to their position(s) on the amino acid sequence, with the alternative amino acid(s) listed; the last column indicates whether the SNP is known or not; the presence of known SNPs in variant protein T08446_PEA_1_P18 (SEQ ID NO:1370) sequence provides support for the deduced sequence of this variant protein according to the present invention).

TABLE 756

Amino acid mutations

| SNP position(s) on amino acid sequence | Alternative amino acid(s) | Previously known SNP? |
|---|---|---|
| 714 | S -> C | Yes |
| 1000 | S -> N | No |
| 1273 | R -> S | No |
| 1274 | N -> H | No |

Variant protein T08446_PEA_1_P18 (SEQ ID NO:1370) is encoded by the following transcript(s): T08446_PEA_1_T2 (SEQ ID NO:97), for which the sequence(s) is/are given at the end of the application. The coding portion of transcript T08446_PEA_1_T2 (SEQ ID NO:97) is shown in bold; this coding portion starts at position 228 and ends at position 4142. The transcript also has the following SNPs as listed in Table 757 (given according to their position on the nucleotide sequence, with the alternative nucleic acid listed; the last column indicates whether the SNP is known or not; the presence of known SNPs in variant protein T08446_PEA_1_P18 (SEQ ID NO:1370) sequence provides support for the deduced sequence of this variant protein according to the present invention).

TABLE 757

Nucleic acid SNPs

| SNP position on nucleotide sequence | Alternative nucleic acid | Previously known SNP? |
|---|---|---|
| 212 | G -> A | Yes |
| 431 | C -> T | Yes |
| 809 | C -> T | Yes |
| 1547 | G -> A | Yes |
| 2368 | C -> G | Yes |
| 3226 | G -> A | No |
| 3284 | C -> G | Yes |
| 3377 | C -> T | Yes |
| 4046 | A -> C | No |
| 4047 | A -> C | No |

Variant protein T08446_PEA_1_P19 (SEQ ID NO:1371) according to the present invention has an amino acid sequence as given at the end of the application; it is encoded by transcript(s) T08446_PEA_1_T22 (SEQ ID NO:98). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein T08446_PEA_1_P19 (SEQ ID NO:1371) also has the following non-silent SNPs (Single Nucleotide Polymorphisms) as listed in Table 758, (given according to their position(s) on the amino acid sequence, with the alternative amino acid(s) listed; the last column indicates whether the SNP is known or not; the presence of known SNPs in variant protein T08446_PEA_1_P19 (SEQ ID NO:1371) sequence provides support for the deduced sequence of this variant protein according to the present invention).

TABLE 758

Amino acid mutations

| SNP position(s) on amino acid sequence | Alternative amino acid(s) | Previously known SNP? |
|---|---|---|
| 194 | D -> G | Yes |

Variant protein T08446_PEA_1_P19 (SEQ ID NO:1371) is encoded by the following transcript(s): T08446_PEA_1_T22 (SEQ ID NO:98), for which the sequence(s) is/are given at the end of the application. The coding portion of transcript T08446_PEA_1_T22 (SEQ ID NO:98) is shown in bold; this coding portion starts at position 228 and ends at position 965. The transcript also has the following SNPs as listed in Table 759 (given according to their position on the nucleotide sequence, with the alternative nucleic acid listed; the last column indicates whether the SNP is known or not; the presence of known SNPs in variant protein T08446_PEA_1_P19 (SEQ ID NO:1371) sequence provides support for the deduced sequence of this variant protein according to the present invention).

TABLE 759

Nucleic acid SNPs

| SNP position on nucleotide sequence | Alternative nucleic acid | Previously known SNP? |
|---|---|---|
| 212 | G -> A | Yes |
| 431 | C -> T | Yes |
| 808 | A -> G | Yes |

As noted above, cluster T08446 features 36 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster T08446_PEA_1_node_2 (SEQ ID NO:706) according to the present invention is supported by 1 libraries. The number of libraries was determined as previously described. This segment can be found in the following transcript(s): T08446_PEA_1_T2 (SEQ ID NO:97) and T08446_PEA_1_T22 (SEQ ID NO:98). Table 760 below describes the starting and ending position of this segment on each transcript.

TABLE 760

Segment location on transcripts

| Transcript name | Segment starting position | Segment ending position |
|---|---|---|
| T08446_PEA_1_T2 (SEQ ID NO:97) | 1 | 287 |
| T08446_PEA_1_T22 (SEQ ID NO:98) | 1 | 287 |

Segment cluster T08446_PEA_1_node_9 (SEQ ID NO:707) according to the present invention is supported by 17 libraries. The number of libraries was determined as previously described. This segment can be found in the following transcript(s): T08446_PEA_1_T2 (SEQ ID NO:97) and T08446_PEA_1_T22 (SEQ ID NO:98). Table 761 below describes the starting and ending position of this segment on each transcript.

TABLE 761

Segment location on transcripts

| Transcript name | Segment starting position | Segment ending position |
|---|---|---|
| T08446_PEA_1_T2 (SEQ ID NO:97) | 552 | 689 |
| T08446_PEA_1_T22 (SEQ ID NO:98) | 552 | 689 |

Segment cluster T08446_PEA_1_node_15 (SEQ ID NO:708) according to the present invention is supported by 0 libraries. The number of libraries was determined as previously described. This segment can be found in the following transcript(s): T08446_PEA_1_T22 (SEQ ID NO:98). Table 762 below describes the starting and ending position of this segment on each transcript.

TABLE 762

Segment location on transcripts

| Transcript name | Segment starting position | Segment ending position |
|---|---|---|
| T08446_PEA_1_T22 (SEQ ID NO:98) | 829 | 968 |

Segment cluster T08446_PEA_1_node_17 (SEQ ID NO:709) according to the present invention is supported by 22 libraries. The number of libraries was determined as previously described. This segment can be found in the following transcript(s): T08446_PEA_1_T2 (SEQ ID NO:97). Table 763 below describes the starting and ending position of this segment on each transcript.

TABLE 763

Segment location on transcripts

| Transcript name | Segment starting position | Segment ending position |
|---|---|---|
| T08446_PEA_1_T2 (SEQ ID NO:97) | 783 | 905 |

Segment cluster T08446_PEA_1_node_25 (SEQ ID NO:710) according to the present invention is supported by 24 libraries. The number of libraries was determined as previously described. This segment can be found in the following transcript(s): T08446_PEA_1_T2 (SEQ ID NO:97). Table 764 below describes the starting and ending position of this segment on each transcript.

TABLE 764

Segment location on transcripts

| Transcript name | Segment starting position | Segment ending position |
|---|---|---|
| T08446_PEA_1_T2 (SEQ ID NO:97) | 1111 | 1263 |

Segment cluster T08446_PEA_1_node_29 (SEQ ID NO:711) according to the present invention is supported by 25 libraries. The number of libraries was determined as previously described. This segment can be found in the following transcript(s): T08446_PEA_1_T2 (SEQ ID NO:97). Table 765 below describes the starting and ending position of this segment on each transcript.

TABLE 765

Segment location on transcripts

| Transcript name | Segment starting position | Segment ending position |
|---|---|---|
| T08446_PEA_1_T2 (SEQ ID NO:97) | 1367 | 1511 |

Segment cluster T08446_PEA_1_node_38 (SEQ ID NO:712) according to the present invention is supported by 20 libraries. The number of libraries was determined as previously described. This segment can be found in the following transcript(s): T08446_PEA_1_T2 (SEQ ID NO:97). Table 766 below describes the starting and ending position of this segment on each transcript.

TABLE 766

Segment location on transcripts

| Transcript name | Segment starting position | Segment ending position |
|---|---|---|
| T08446_PEA_1_T2 (SEQ ID NO:97) | 1703 | 1848 |

Segment cluster T08446_PEA_1_node_43 (SEQ ID NO:713) according to the present invention is supported by 15 libraries. The number of libraries was determined as previously described. This segment can be found in the following transcript(s): T08446_PEA_1_T2 (SEQ ID NO:97). Table 767 below describes the starting and ending position of this segment on each transcript.

TABLE 767

Segment location on transcripts

| Transcript name | Segment starting position | Segment ending position |
|---|---|---|
| T08446_PEA_1_T2 (SEQ ID NO:97) | 1849 | 2002 |

Segment cluster T08446_PEA_1_node_51 (SEQ ID NO:714) according to the present invention is supported by 19 libraries. The number of libraries was determined as previously described. This segment can be found in the following transcript(s): T08446_PEA_1_T2 (SEQ ID NO:97). Table 768 below describes the starting and ending position of this segment on each transcript.

TABLE 768

Segment location on transcripts

| Transcript name | Segment starting position | Segment ending position |
|---|---|---|
| T08446_PEA_1_T2 (SEQ ID NO:97) | 2224 | 2571 |

Segment cluster T08446_PEA_1_node_52 (SEQ ID NO:715) according to the present invention is supported by 15 libraries. The number of libraries was determined as previously described. This segment can be found in the following transcript(s): T08446_PEA_1_T2 (SEQ ID NO:97). Table 769 below describes the starting and ending position of this segment on each transcript.

TABLE 769

Segment location on transcripts

| Transcript name | Segment starting position | Segment ending position |
|---|---|---|
| T08446_PEA_1_T2 (SEQ ID NO:97) | 2572 | 2694 |

Segment cluster T08446_PEA_1_node_55 (SEQ ID NO:716) according to the present invention is supported by 21 libraries. The number of libraries was determined as previously described. This segment can be found in the following transcript(s): T08446_PEA_1_T2 (SEQ ID NO:97). Table 770 below describes the starting and ending position of this segment on each transcript.

TABLE 770

Segment location on transcripts

| Transcript name | Segment starting position | Segment ending position |
|---|---|---|
| T08446_PEA_1_T2 (SEQ ID NO:97) | 2707 | 2883 |

Segment cluster T08446_PEA_1_node_57 (SEQ ID NO:717) according to the present invention is supported by 37 libraries. The number of libraries was determined as previously described. This segment can be found in the following transcript(s): T08446_PEA_1_T2 (SEQ ID NO:97). Table 771 below describes the starting and ending position of this segment on each transcript.

TABLE 771

Segment location on transcripts

| Transcript name | Segment starting position | Segment ending position |
|---|---|---|
| T08446_PEA_1_T2 (SEQ ID NO:97) | 2884 | 3275 |

Segment cluster T08446_PEA_1_node_59 (SEQ ID NO:718) according to the present invention is supported by 36 libraries. The number of libraries was determined as previously described. This segment can be found in the following transcript(s): T08446_PEA_1_T2 (SEQ ID NO:97). Table 772 below describes the starting and ending position of this segment on each transcript.

TABLE 772

Segment location on transcripts

| Transcript name | Segment starting position | Segment ending position |
|---|---|---|
| T08446_PEA_1_T2 (SEQ ID NO:97) | 3360 | 3670 |

Segment cluster T08446_PEA_1_node_62 (SEQ ID NO:719) according to the present invention is supported by 36 libraries. The number of libraries was determined as previously described. This segment can be found in the following transcript(s): T08446_PEA_1_T2 (SEQ ID NO:97). Table 773 below describes the starting and ending position of this segment on each transcript.

TABLE 773

Segment location on transcripts

| Transcript name | Segment starting position | Segment ending position |
|---|---|---|
| T08446_PEA_1_T2 (SEQ ID NO:97) | 3783 | 3988 |

Segment cluster T08446_PEA_1_node_63 (SEQ ID NO:720) according to the present invention is supported by 64 libraries. The number of libraries was determined as previously described. This segment can be found in the following transcript(s): T08446_PEA_1_T2 (SEQ ID NO:97). Table 774 below describes the starting and ending position of this segment on each transcript.

TABLE 774

Segment location on transcripts

| Transcript name | Segment starting position | Segment ending position |
| --- | --- | --- |
| T08446_PEA_1_T2 (SEQ ID NO:97) | 3989 | 4414 |

According to an optional embodiment of the present invention, short segments related to the above cluster are also provided. These segments are up to about 120 bp in length, and so are included in a separate description.

Segment cluster T08446_PEA_1_node_3 (SEQ ID NO:721) according to the present invention is supported by 14 libraries. The number of libraries was determined as previously described. This segment can be found in the following transcript(s): T08446_PEA_1_T2 (SEQ ID NO:97) and T08446_PEA_1_T22 (SEQ ID NO:98). Table 775 below describes the starting and ending position of this segment on each transcript.

TABLE 775

Segment location on transcripts

| Transcript name | Segment starting position | Segment ending position |
| --- | --- | --- |
| T08446_PEA_1_T2 (SEQ ID NO:97) | 288 | 385 |
| T08446_PEA_1_T22 (SEQ ID NO:98) | 288 | 385 |

Segment cluster T08446_PEA_1_node_5 (SEQ ID NO:722) according to the present invention is supported by 17 libraries. The number of libraries was determined as previously described. This segment can be found in the following transcript(s): T08446_PEA_1_T2 (SEQ ID NO:97) and T08446_PEA_1_T22 (SEQ ID NO:98). Table 776 below describes the starting and ending position of this segment on each transcript.

TABLE 776

Segment location on transcripts

| Transcript name | Segment starting position | Segment ending position |
| --- | --- | --- |
| T08446_PEA_1_T2 (SEQ ID NO:97) | 386 | 470 |
| T08446_PEA_1_T22 (SEQ ID NO:98) | 386 | 470 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 777.

TABLE 777

Oligonucleotides related to this segment

| Oligonucleotide name | Overexpressed in cancers | Chip reference |
| --- | --- | --- |
| T08446_0_9_0 (SEQ ID NO: 234) | lung malignant tumors | LUN |

Segment cluster T08446_PEA_1_node_7 (SEQ ID NO:723) according to the present invention is supported by 19 libraries. The number of libraries was determined as previously described. This segment can be found in the following transcript(s): T08446_PEA_1_T2 (SEQ ID NO:97) and T08446_PEA_1_T22 (SEQ ID NO:98). Table 778 below describes the starting and ending position of this segment on each transcript.

TABLE 778

Segment location on transcripts

| Transcript name | Segment starting position | Segment ending position |
| --- | --- | --- |
| T08446_PEA_1_T2 (SEQ ID NO:97) | 471 | 551 |
| T08446_PEA_1_T22 (SEQ ID NO:98) | 471 | 551 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 779.

TABLE 779

Oligonucleotides related to this segment

| Oligonucleotide name | Overexpressed in cancers | Chip reference |
| --- | --- | --- |
| T08446_0_9_0 (SEQ ID NO: 234) | lung malignant tumors | LUN |

Segment cluster T08446_PEA_1_node_12 (SEQ ID NO:724) according to the present invention is supported by 14 libraries. The number of libraries was determined as previously described. This segment can be found in the following transcript(s): T08446_PEA_1_T2 (SEQ ID NO:97) and T08446_PEA_1_T22 (SEQ ID NO:98). Table 780 below describes the starting and ending position of this segment on each transcript.

TABLE 780

Segment location on transcripts

| Transcript name | Segment starting position | Segment ending position |
| --- | --- | --- |
| T08446_PEA_1_T2 (SEQ ID NO:97) | 690 | 782 |
| T08446_PEA_1_T22 (SEQ ID NO:98) | 690 | 782 |

Segment cluster T08446_PEA_1_node_13 (SEQ ID NO:725) according to the present invention is supported by 0 libraries. The number of libraries was determined as previously described. This segment can be found in the following transcript(s): T08446_PEA_1_T22 (SEQ ID NO:98). Table 781 below describes the starting and ending position of this segment on each transcript.

TABLE 781

Segment location on transcripts

| Transcript name | Segment starting position | Segment ending position |
|---|---|---|
| T08446_PEA_1_T22 (SEQ ID NO:98) | 783 | 828 |

Segment cluster T08446_PEA_1_node_19 (SEQ ID NO:726) according to the present invention is supported by 19 libraries. The number of libraries was determined as previously described. This segment can be found in the following transcript(s): T08446_PEA_1_T2 (SEQ ID NO:97). Table 782 below describes the starting and ending position of this segment on each transcript.

TABLE 782

Segment location on transcripts

| Transcript name | Segment starting position | Segment ending position |
|---|---|---|
| T08446_PEA_1_T2 (SEQ ID NO:97) | 906 | 983 |

Segment cluster T08446_PEA_1_node_21 (SEQ ID NO:727) according to the present invention is supported by 21 libraries. The number of libraries was determined as previously described. This segment can be found in the following transcript(s): T08446_PEA_1_T2 (SEQ ID NO:97). Table 783 below describes the starting and ending position of this segment on each transcript.

TABLE 783

Segment location on transcripts

| Transcript name | Segment starting position | Segment ending position |
|---|---|---|
| T08446_PEA_1_T2 (SEQ ID NO:97) | 984 | 1050 |

Segment cluster T08446_PEA_1_node_23 (SEQ ID NO:728) according to the present invention is supported by 22 libraries. The number of libraries was determined as previously described. This segment can be found in the following transcript(s): T08446_PEA_1_T2 (SEQ ID NO:97). Table 784 below describes the starting and ending position of this segment on each transcript.

TABLE 784

Segment location on transcripts

| Transcript name | Segment starting position | Segment ending position |
|---|---|---|
| T08446_PEA_1_T2 (SEQ ID NO:97) | 1051 | 1110 |

Segment cluster T08446_PEA_1_node_27 (SEQ ID NO:729) according to the present invention is supported by 23 libraries. The number of libraries was determined as previously described. This segment can be found in the following transcript(s): T08446_PEA_1_T2 (SEQ ID NO:97). Table 785 below describes the starting and ending position of this segment on each transcript.

TABLE 785

Segment location on transcripts

| Transcript name | Segment starting position | Segment ending position |
|---|---|---|
| T08446_PEA_1_T2 (SEQ ID NO:97) | 1264 | 1366 |

Segment cluster T08446_PEA_1_node_32 (SEQ ID NO:730) according to the present invention is supported by 23 libraries. The number of libraries was determined as previously described. This segment can be found in the following transcript(s): T08446_PEA_1_T2 (SEQ ID NO:97). Table 786 below describes the starting and ending position of this segment on each transcript.

TABLE 786

Segment location on transcripts

| Transcript name | Segment starting position | Segment ending position |
|---|---|---|
| T08446_PEA_1_T2 (SEQ ID NO:97) | 1512 | 1594 |

Segment cluster T08446_PEA_1_node_34 (SEQ ID NO:731) according to the present invention is supported by 22 libraries. The number of libraries was determined as previously described. This segment can be found in the following transcript(s): T08446_PEA_1_T2 (SEQ ID NO:97). Table 787 below describes the starting and ending position of this segment on each transcript.

TABLE 787

Segment location on transcripts

| Transcript name | Segment starting position | Segment ending position |
|---|---|---|
| T08446_PEA_1_T2 (SEQ ID NO:97) | 1595 | 1702 |

Segment cluster T08446_PEA_1_node_45 (SEQ ID NO:732) according to the present invention is supported by 19 libraries. The number of libraries was determined as previously described. This segment can be found in the following transcript(s): T08446_PEA_1_T2 (SEQ ID NO:97). Table 788 below describes the starting and ending position of this segment on each transcript.

TABLE 788

Segment location on transcripts

| Transcript name | Segment starting position | Segment ending position |
|---|---|---|
| T08446_PEA_1_T2 (SEQ ID NO:97) | 2003 | 2091 |

Segment cluster T08446_PEA_1_node_46 (SEQ ID NO:733) according to the present invention is supported by 18 libraries. The number of libraries was determined as previously described. This segment can be found in the following transcript(s): T08446_PEA_1_T2 (SEQ ID NO:97). Table 789 below describes the starting and ending position of this segment on each transcript.

TABLE 789

Segment location on transcripts

| Transcript name | Segment starting position | Segment ending position |
|---|---|---|
| T08446_PEA_1_T2 (SEQ ID NO:97) | 2092 | 2148 |

Segment cluster T08446_PEA_1_node_48 (SEQ ID NO:734) according to the present invention is supported by 19 libraries. The number of libraries was determined as previously described. This segment can be found in the following transcript(s): T08446_PEA_1_T2 (SEQ ID NO:97). Table 790 below describes the starting and ending position of this segment on each transcript.

TABLE 790

Segment location on transcripts

| Transcript name | Segment starting position | Segment ending position |
|---|---|---|
| T08446_PEA_1_T2 (SEQ ID NO:97) | 2149 | 2223 |

Segment cluster T08446_PEA_1_node_54 (SEQ ID NO:735) according to the present invention can be found in the following transcript(s): T08446_PEA_1_T2 (SEQ ID NO:97). Table 791 below describes the starting and ending position of this segment on each transcript.

TABLE 791

Segment location on transcripts

| Transcript name | Segment starting position | Segment ending position |
|---|---|---|
| T08446_PEA_1_T2 (SEQ ID NO:97) | 2695 | 2706 |

Segment cluster T08446_PEA_1_node_58 (SEQ ID NO:736) according to the present invention is supported by 13 libraries. The number of libraries was determined as previously described. This segment can be found in the following transcript(s): T08446_PEA_1_T2 (SEQ ID NO:97). Table 792 below describes the starting and ending position of this segment on each transcript.

TABLE 792

Segment location on transcripts

| Transcript name | Segment starting position | Segment ending position |
|---|---|---|
| T08446_PEA_1_T2 (SEQ ID NO:97) | 3276 | 3359 |

Segment cluster T08446_PEA_1_node_60 (SEQ ID NO:737) according to the present invention is supported by 27 libraries. The number of libraries was determined as previously described. This segment can be found in the following transcript(s): T08446_PEA_1_T2 (SEQ ID NO:97). Table 793 below describes the starting and ending position of this segment on each transcript.

TABLE 793

Segment location on transcripts

| Transcript name | Segment starting position | Segment ending position |
|---|---|---|
| T08446_PEA_1_T2 (SEQ ID NO:97) | 3671 | 3720 |

Segment cluster T08446_PEA_1_node_61 (SEQ ID NO:738) according to the present invention is supported by 25 libraries. The number of libraries was determined as previously described. This segment can be found in the following transcript(s): T08446_PEA_1_T2 (SEQ ID NO:97). Table 794 below describes the starting and ending position of this segment on each transcript.

TABLE 794

Segment location on transcripts

| Transcript name | Segment starting position | Segment ending position |
|---|---|---|
| T08446_PEA_1_T2 (SEQ ID NO:97) | 3721 | 3782 |

Segment cluster T08446_PEA_1_node_64 (SEQ ID NO:739) according to the present invention can be found in the following transcript(s): T08446_PEA_1_T2 (SEQ ID NO:97). Table 795 below describes the starting and ending position of this segment on each transcript.

TABLE 795

Segment location on transcripts

| Transcript name | Segment starting position | Segment ending position |
|---|---|---|
| T08446_PEA_1_T2 (SEQ ID NO:97) | 4415 | 4420 |

Segment cluster T08446_PEA_1_node_65 (SEQ ID NO:740) according to the present invention is supported by 39 libraries. The number of libraries was determined as previously described. This segment can be found in the following transcript(s): T08446_PEA_1_T2 (SEQ ID NO:97). Table 796 below describes the starting and ending position of this segment on each transcript.

TABLE 796

Segment location on transcripts

| Transcript name | Segment starting position | Segment ending position |
|---|---|---|
| T08446_PEA_1_T2 (SEQ ID NO:97) | 4421 | 4472 |

Segment cluster T08446_PEA_1_node_66 (SEQ ID NO:741) according to the present invention is supported by 29 libraries. The number of libraries was determined as previously described. This segment can be found in the following transcript(s): T08446_PEA_1_T2 (SEQ ID NO:97). Table 797 below describes the starting and ending position of this segment on each transcript.

TABLE 797

Segment location on transcripts

| Transcript name | Segment starting position | Segment ending position |
|---|---|---|
| T08446_PEA_1_T2 (SEQ ID NO:97) | 4473 | 4539 |

Variant protein alignment to the previously known protein:

Sequence name: SNXQ_HUMAN (SEQ ID NO:1442)

Sequence documentation:

Alignment of: T08446_PEA_1_P18 (SEQ ID NO:1370) x SNXQ_HUMAN (SEQ ID NO:1442) . . .

Alignment segment 1/1:

| | | | |
|---|---|---|---|
| Quality: | 1835.00 | Escore: | 0 |
| Matching length: | 185 | Total length: | 185 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MLSLSLCSHLWGPLILSALQARSTDSLDGPGEGSVQPLPTAGGPSVKGKP  50
    ||||||||||||||||||||||||||||||||||||||||||||||||||
  1 MLSLSLCSHLWGPLILSALQARSTDSLDGPGEGSVQPLPTAGGPSVKGKP  50

51 GKRLSAPRGPFPRLADCAHFHYENVDFGHIQLLLSPDREGPSLSGENELV 100
    ||||||||||||||||||||||||||||||||||||||||||||||||||
 51 GKRLSAPRGPFPRLADCAHFHYENVDFGHIQLLLSPDREGPSLSGENELV 100

101 FGVQVTCQGRSWPVLRSYDDFRSLDAHLHRCIFDRRFSCLPELPPPPEGA 150
    ||||||||||||||||||||||||||||||||||||||||||||||||||
101 FGVQVTCQGRSWPVLRSYDDFRSLDAHLHRCIFDRRFSCLPELPPPPEGA 150

151 RAAQMLVPLLLQYLETLSGLVDSNLNCGPVLTWME               185
    |||||||||||||||||||||||||||||||||||
151 RAAQMLVPLLLQYLETLSGLVDSNLNCGPVLTWME               185
```

Sequence name: □9NT23 (SEQ ID NO:1443)

Sequence documentation:

Alignment of: T08446_PEA_1_P18 (SEQ ID NO:1370) x Q9NT23 (SEQ ID NO:1443)

Alignment segment 1/1:

| | |
|---|---|
| Quality: 8548.00 | Escore: 0 |
| Matching length: 862 | Total length: 862 |
| Matching Percent Similarity: 99.88 | Matching Percent Identity: 99.88 |
| Total Percent Similarity: 99.88 | Total Percent Identity: 99.88 |
| Gaps: 0 | |

Alignment:

```
444 HDVIQQLPPPHYRTLEYLLRHLARMARHSANTSMHARNLAIVWAPNLLRS 493
    ||||||||||||||||||||||||||||||||||||||||||||||||||
  1 HDVIQQLPPPHYRTLEYLLRHLARMARHSANTSMHARNLAIVWAPNLLRS  50

494 MELESVGMGGAAAFREVRVQSVVVEFLLTHVDVLFSDTFTSAGLDPAGRC 543
    ||||||||||||||||||||||||||||||||||||||||||||||||||
 51 MELESVGMGGAAAFREVRVQSVVVEFLLTHVDVLFSDTFTSAGLDPAGRC 100

544 LLPRPKSLAGSCPSTRLLTLEEAQARTQGRLGTPTEPTTPKAPASPAERR 593
    ||||||||||||||||||||||||||||||||||||||||||||||||||
101 LLPRPKSLAGSCPSTRLLTLEEAQARTQGRLGTPTEPTTPKAPASPAERR 150

594 KGERGEKQRKPGGSSWKTFFALGRGPSVPRKKPLPWLGGTRAPPQPSGSR 643
    ||||||||||||||||||||||||||||||||||||||||||||||||||
151 KGERGEKQRKPGGSSWKTFFALGRGPSVPRKKPLPWLGGTRAPPQPSGSR 200

644 PDTVTLRSAKSEESLSSQASGAGLQRLHRLRRPHSSSDAFPVGPAPAGSC 693
    ||||||||||||||||||||||||||||||||||||||||||||||||||
201 PDTVTLRSAKSEESLSSQASGAGLQRLHRLRRPHSSSDAFPVGPAPAGSC 250

694 ESLSSSSSSESSSSESSSSSSESSAAGLGALSGSPSHRTSAWLDDGDELD 743
    ||||||||||||||||||||||||||||||||||||||||||||||||||
251 ESLSSSSSSESSSSESSSSSSESSAAGLGALSGSPSHRTSAWLDDGDELD 300
```

-continued

```
 744 FSPPRCLEGLRGLDFDPLTFRCSSPTPGDPAPPASPAPPAPASAFPPRVT  793
     ||||||||||||||||||||||||||||||||||||||||||||||||||
 301 FSPPRCLEGLRGLDFDPLTFRCSSPTPGDPAPPASPAPPAPASAFPPRVT  350

794 PQAISPRGPTSPASPAALDISEPLAVSVPPAVLELLGAGGAPASATPTPA  843
     ||||||||||||||||||||||||||||||||||||||||||||||||||
 351 PQAISPRGPTSPASPAALDISEPLAVSVPPAVLELLGAGGAPASATPTPA  400

844 LSPGRSLRPHLIPLLLRGAEAPLTDACQQEMCSKLRGAQGPLGPDMESPL  893
     ||||||||||||||||||||||||||||||||||||||||||||||||||
 401 LSPGRSLRPHLIPLLLRGAEAPLTDACQQEMCSKLRGAQGPLGPDMESPL  450

894 PPPPLSLLRPGGAPPPPPKNPARLMALALAERAQQVAEQQSQQECGGTPP  943
     ||||||||||||||||||||||||||||||||||||||||||||||||||
 451 PPPPLSLLRPGGAPPPPPKNPARLMALALAERAQQVAEQQSQQECGGTPP  500

944 ASQSPFHRSLSLEVGGEPLGTSGSGPPPNSLAHPGAWVPGPPPYLPRQQS  993
     ||||||||||||||||||||||||||||||||||||||||||||||||||
 501 ASQSPFHRSLSLEVGGEPLGTSGSGPPPNSLAHPGAWVPGPPPYLPRQQS  550

994 DGSLLRSQRPMGTSRRGLRGPAQVSAQLRAGGGGRDAPEAAAQSPCSVPS 1043
     ||||||||||||||||||||||||||||||||||||||||||||||||||
 551 DGSLLRSQRPMGTSRRGLRGPAQVSAQLRAGGGGRDAPEAAAQSPCSVPS  600

1044 QVPTPGFFSPAPRECLPPFLGVPKPGLYPLGPPSFQPSSPAPVWRSSLGP 1093
     ||||||||||||||||||||||||||||||||||||||||||||||||||
 601 QVPTPGFFSPAPRECLPPFLGVPKPGLYPLGPPSFQPSSPAPVWRSSLGP  650

1094 PAPLDRGENLYYEIGASEGSPYSGPTRSWSPFRSMPPDRLNASYGMLGQS 1143
     ||||||||||||||||||||||||||||||||||||||||||||||||||
 651 PAPLDRGENLYYEIGASEGSPYSGLTRSWSPFRSMPPDRLNASYGMLGQS  700

1144 PPLHRSPDFLLSYPPAPSCFPPDHLGYSAPQHPARRPTPPEPLYVNLALG 1193
     ||||||||||||||||||||||||||||||||||||||||||||||||||
 701 PPLHRSPDFLLSYPPAPSCFPPDHLGYSAPQHPARRPTPPEPLYVNLALG  750

1194 PRGPSPASSSSSSPPAHPRSRSDPGPPVPRLPQKQRAPWGPRTPHRVPGP 1243
     ||||||||||||||||||||||||||||||||||||||||||||||||||
 751 PRGPSPASSSSSSPPAHPRSRSDPGPPVPRLPQKQRAPWGPRTPHRVPGP  800

1244 WGPPEPLLLYRAAPPAYGRGGELHRGSLYRNGGQRGEGAGPPPPYPTPSW 1283
     ||||||||||||||||||||||||||||||||||||||||||||||||||
 801 WGPPEPLLLYRAAPPAYGRGGELHRGSLYRNGGQRGEGAGPPPPYPTPSW  850

1294 SLHSEGQTRSYC                                       1305
     ||||||||||||
 851 SLHSEGQTRSYC                                        862
```

Sequence name: □96CP3 (SEQ ID NO:1444)

Sequence documentation:

Alignment of: T08446_PEA_1_P18 (SEQ ID NO:1370) x Q96CP3 (SEQ ID NO:1444)

Quality: 3019.00
Matching length: 295
Matching Percent Similarity: 100.00
Total Percent Similarity: 100.00
Gaps: 0

Escore: 0
Total length: 295
Matching Percent Identity: 100.00
Total PercentIdentity: 100.00

Alignment segment 1/1:

Alignment:

```
1011 LRGPAQVSAQLRAGGGGRDAPEAAAQSPCSVPSQVPTPGFFSPAPRECLP 1060
     ||||||||||||||||||||||||||||||||||||||||||||||||||
   1 LRGPAQVSAQLRAGGGGRDAPEAAAQSPCSVPSQVPTPGFFSPAPRECLP   50

1061 PFLGVPKPGLYPLGPPSFQPSSPAPVWRSSLGPPAPLDRGENLYYEIGAS 1110
     ||||||||||||||||||||||||||||||||||||||||||||||||||
  51 PFLGVPKPGLYPLGPPSFQPSSPAPVWRSSLGPPAPLDRGENLYYEIGAS  100

1111 EGSPYSGPTRSWSPFRSMPPDRLNASYGMLGQSPPLHRSPDFLLSYPPAP 1160
     ||||||||||||||||||||||||||||||||||||||||||||||||||
 101 EGSPYSGPTRSWSPFRSMPPDRLNASYGMLGQSPPLHRSPDFLLSYPPAP  150

1161 SCFPPDHLGYSAPQHPARRPTPPEPLYVNLALGPRGPSPASSSSSSPPAH 1210
     ||||||||||||||||||||||||||||||||||||||||||||||||||
 151 SCFPPDHLGYSAPQHPARRPTPPEPLYVNLALGPRGPSPASSSSSSPPAH  200

1211 PRSRSDPGPPVPRLPQKQRAPWGPRTPHRVPGPWGPPEPLLLYRAAPPAY 1260
     ||||||||||||||||||||||||||||||||||||||||||||||||||
 201 PRSRSDPGPPVPRLPQKQRAPWGPRTPHRVPGPWGPPEPLLLYRAAPPAY  250
```

-continued

```
1261 GRGGELHRGSLYRNGGQRGEGAGPPPPYPTPSWSLHSEGQTRSYC 1305
     |||||||||||||||||||||||||||||||||||||||||||||
 251 GRGGELHRGSLYRNGGQRGEGAGPPPPYPTPSWSLHSEGQTRSYC  295
```

Sequence name: BAC86902 (SEQ ID NO:1445)

Sequence documentation:

Alignment of: T08446_PEA_1_P18 (SEQ ID NO:1370) x BAC86902 (SEQ ID NO:1445)

Quality: 9651.00
Matching length: 991
Matching Percent Similarity: 99.90
Total Percent Similarity: 97.15
Gaps: 1

Escore: 0
Total length: 1019
Matching Percent Identity: 99.90
Total Percent Identity: 97.15

Alignment segment 1/1:

Alignment:

```
155 MLVPLLLQYLETLSGLVDSNLNCGPVLTWMELDNHGRRLLLSEEASLNIP 204
    |||||||||||||||||||||||||||||||||||||||||||||||||
  1 MLVPLLLQYLETLSGLVDSNLNCGPVLTWMELDNHGRRLLLSEEASLNIP  50

205 AVAAAHVIKRYTAQAPDELSFEVGDIVSVIDMPPTEDRSWWRGKRGFQVG 254
    |||||||||||||||||||||||||||||||||||||||||||||||||
 51 AVAAAHVIKRYTAQAPDELSFEVGDIVSVIDMPPTEDRSWWRGKRGFQVG 100

255 FFPSECVELFTERPGPGLKADADGPPCGIPAPQGISSLTSAVPRPRGKLA 304
    |||||||||||||||||||||||||||||||||||||||||||||||||
101 FFPSECVELFTERPGPGLKADADGPPCGIPAPQGISSLTSAVPRPRGKLA 150

305 GLLRTFMRSRPSRQRLRQRGILRQRVFGCDLGEHLSNSGQDVPQVLRCCS 354
    |||||||||||||||||||||||||||||||||||||||||||||||||
151 GLLRTFMRSRPSRQRLRQRGILRQRVFGCDLGEHLSNSGQDVPQVLRCCS 200

355 EFIEAHGVVDGIYRLSGVSSNIQRLRHEFDSERIPELSGPAFLQDIHSVS 404
    |||||||||||||||||||||||||||||||||||||||||||||||||
201 EFIEAHGVVDGIYRLSGVSSNIQRLRHEFDSERIPELSGPAFLQDIHSVS 250

405 SLCKLYFRELPNPLLTYQLYGKFSEAMSVPGEEERLVRVHDVIQQLPPPH 454
    |||||||||||||||||||||||||||||||||||||||||||||||||
251 SLCKLYFRELPNPLLTYQLYGKFSEAMSVPGEEERLVRVHDVIQQLPPPH 300

455 YRTLEYLLRHLARMARHSANTSMHARNLAIVWAPNLLRSMELESVGMGGA 504
    |||||||||||||||||||||||||||||||||||||||||||||||||
301 YRTLEYLLRHLARMARHSANTSMHARNLAIVWAPNLLRSMELESVGMGGA 350

505 AAFREVRVQSVVVEFLLTHVDVLFSDTFTSAGLDPAGRCLLPRPKSLAGS 554
    |||||||||||||||||||||||||||||||||||||||||||||||||
351 AAFREVRVQSVVVEFLLTHVDVLFSDTFTSAGLDPAGRCLLPRPKSLAGS 400

555 CPSTRLLTLEEAQARTQGRLGTPTEPTTPKAPASPAERRKGERGEKQRKP 604
    |||||||||||||||||||||||||||||||||||||||||||||||||
401 CPSTRLLTLEEAQARTQGRLGTPTEPTTPKAPASPAERRKGERGEKQRKP 450

605 GGSSWKTFFALGRGPSVPRKKPLPWLGGTRAPPQPSGSRPDTVTLRSAKS 654
    |||||||||||||||||||||||||||||||||||||||||||||||||
451 GGSSWKTFFALGRGPSVPRKKPLPWLGGTRAPPQPSGSRPDTVTLRSAKS 500

655 EESLSSQASGAGLQRLHRLRRPHSSSDAFPVGPAPAGSCESLSSSSSSES 704
    |||||||||||||||||||||||||||||||||||||||||||||||||
501 EESLSSQASGAGLQRLHRLRRPHSSSDAFPVGPAPAGSCESLSSSSSSES 550

705 SSSESSSSSSESSAAGLGALSGSPSHRTSAWLDDGDELDFSPPRCLEGLR 754
    |||||||||||||||||||||||||||||||||||||||||||||||||
551 SSSESSSSSSESSAAGLGALSGSPSHRTSAWLDDGDELDFSPPRCLEGLR 600

755 GLDFDPLTFRCSSPTPGDPAPPASPAPPAPASAFPPRVTPQAISPRGPTS 804
    |||||||||||||||||||||||||||||||||||||||||||||||||
601 GLDFDPLTFRCSSPTPGDPAPPASPAPPAPASAFPPRVTPQAISPRGPTS 650

805 PASPAALDISEPLAVSVPPAVLELLGAGGAPASATPTPALSPGRSLRPHL 854
    |||||||||||||||||||||||||||||||||||||||||||||||||
651 PASPAALDISEPLAVSVPPAVLELLGAGGAPASATPTPALSPGRSLRPHL 700

855 IPLLLRGAEAPLTDACQQEMCSKLRGAQGPLGPDMESPLPPPPLSLLRPG 904
    |||||||||||||||||||||||||||||||||||||||||||||||||
701 IPLLLRGAEAPLTDACQQEMCSKLRGAQGPLGPDMESPLPPPPLSLLRPG 750

905 GAPPPPPKNPARLMALALAERAQQVAEQQSQQECGGTPPASQSPFHRSLS 954
    |||||||||||||||||||||||||||||||||||||||||||||||||
751 GAPPPPPKNPARLMALALAERAQQVAEQQSQQECGGTPPASQSPFHRSLS 800
```

```
 955 LEVGGEPLGTSGSGPPPNSLAHPGAWVPGPPPYLPRQQSDGSLLRSQRPM 1004
     ||||||||||||||||||||||||||||||||||||||||||||||||||
 801 LEVGGEPLGTSGSGPPPNSLAHPGAWVPGPPPYLPRQQSDGSLLRSQRPM  850

1005 GTSRRGLRGPAQVSAQLRAGGGGRDAPEAAAQSPCSVPSQVPTPGFFSPA 1054
     ||||||||||                              ||||||||||
 851 GTSRRGLRGPA........................    QVPTPGFFSPA  872

1055 PRECLPPFLGVPKPGLYPLGPPSFQPSSPAPVWRSSLGPPAPLDRGENLY 1104
     ||||||||||||||||||||||||||||||||||||||||||||||||||
 873 PRECLPPFLGVPKPGLYPLGPPSFQPSSPAPVWRSSLGPPAPLDRGENLY  922

1105 YEIGASEGSPYSGPTRSWSPFRSMPPDRLNASYGMLGQSPPLHRSPDFLL 1154
     ||||||||||||||||||||||||||||||||||||||||||||||||||
 923 YEIGASEGSPYSGPTRSWSPFRSMPPDRLNASYGMLGQSPPLHRSPDFLL  972

1155 SYPPAPSCFPPDHLGYSAP                               1173
     |||||||||||||||||||
 973 SYPPAPSCFPPDHLGYSPP                                991
```

Description for Cluster HUMCA1XIA

Cluster HUMCA1 XIA features 4 transcript(s) and 46 segment(s) of interest, the names for which are given in Tables 798 and 799, respectively, the sequences themselves are given at the end of the application. The selected protein variants are given in table 800

TABLE 798

Transcripts of interest

| Transcript Name | Sequence ID No. |
|---|---|
| HUMCA1XIA_T16 | 99 |
| HUMCA1XIA_T17 | 100 |
| HUMCA1XIA_T19 | 101 |
| HUMCA1XIA_T20 | 102 |

TABLE 799

Segments of interest

| Segment Name | Sequence ID No. |
|---|---|
| HUMCA1XIA_node_0 | 742 |
| HUMCA1XIA_node_2 | 743 |
| HUMCA1XIA_node_4 | 744 |
| HUMCA1XIA_node_6 | 745 |
| HUMCA1XIA_node_8 | 746 |
| HUMCA1XIA_node_9 | 747 |
| HUMCA1XIA_node_18 | 748 |
| HUMCA1XIA_node_54 | 749 |
| HUMCA1XIA_node_55 | 750 |
| HUMCA1XIA_node_92 | 751 |
| HUMCA1XIA_node_11 | 752 |
| HUMCA1XIA_node_15 | 753 |
| HUMCA1XIA_node_19 | 754 |
| HUMCA1XIA_node_21 | 755 |
| HUMCA1XIA_node_23 | 756 |
| HUMCA1XIA_node_25 | 757 |
| HUMCA1XIA_node_27 | 758 |
| HUMCA1XIA_node_29 | 759 |
| HUMCA1XIA_node_31 | 760 |
| HUMCA1XIA_node_33 | 761 |
| HUMCA1XIA_node_35 | 762 |
| HUMCA1XIA_node_37 | 763 |
| HUMCA1XIA_node_39 | 764 |
| HUMCA1XIA_node_41 | 765 |
| HUMCA1XIA_node_43 | 766 |
| HUMCA1XIA_node_45 | 767 |
| HUMCA1XIA_node_47 | 769 |
| HUMCA1XIA_node_49 | 769 |
| HUMCA1XIA_node_51 | 770 |

TABLE 799-continued

Segments of interest

| Segment Name | Sequence ID No. |
|---|---|
| HUMCA1XIA_node_57 | 771 |
| HUMCA1XIA_node_59 | 772 |
| HUMCA1XIA_node_62 | 773 |
| HUMCA1XIA_node_64 | 774 |
| HUMCA1XIA_node_66 | 775 |
| HUMCA1XIA_node_68 | 776 |
| HUMCA1XIA_node_70 | 777 |
| HUMCA1XIA_node_72 | 778 |
| HUMCA1XIA_node_74 | 779 |
| HUMCA1XIA_node_76 | 780 |
| HUMCA1XIA_node_78 | 782 |
| HUMCA1XIA_node_81 | 783 |
| HUMCA1XIA_node_83 | 784 |
| HUMCA1XIA_node_85 | 785 |
| HUMCA1XIA_node_87 | 786 |
| HUMCA1XIA_node_89 | 787 |
| HUMCA1XIA_node_91 | 788 |

TABLE 800

Proteins of interest

| Protein Name | Sequence ID No. | Corresponding Transcript(s) |
|---|---|---|
| HUMCA1XIA_P14 | 1372 | HUMCA1XIA_T16 (SEQ ID NO:99) |
| HUMCA1XIA_P15 | 1373 | HUMCA1XIA_T17 (SEQ ID NO: 100) |
| HUMCA1XIA_P16 | 1374 | HUMCA1XIA_T19 (SEQ ID NO: 101) |
| HUMCA1XIA_P17 | 1375 | HUMCA1XIA_T20 (SEQ ID NO: 102) |

These sequences are variants of the known protein Collagen alpha 1 (SwissProt accession identifier CA1B_HUMAN), SEQ ID NO:1446, referred to herein as the previously known protein.

Protein Collagen alpha 1 (SEQ ID NO:1446) is known or believed to have the following function(s): May play an important role in fibrillogenesis by controlling lateral growth of collagen II fibrils. The sequence for protein Collagen alpha 1 is given at the end of the application, as "Collagen alpha 1 amino acid sequence". Known polymorphisms for this sequence are as shown in Table 801.

TABLE 801

Amino acid mutations for Known Protein

| SNP position(s) on amino acid sequence | Comment |
|---|---|
| 625 | G -> V (in STL2). /FTId = VAR_013583. |
| 676 | G -> R (in STL2; overlapping phenotype with Marshall syndrome). /FTId = VAR_013584. |
| 921-926 | Missing (in STL2; overlapping phenotype with Marshall syndrome). /FTId = VAR_013585. |
| 1313-1315 | Missing (in STL2; overlapping phenotype with Marshall syndrome). /FTId = VAR_013586. |
| 1516 | G -> V (in STL2; overlapping phenotype with Marshall syndrome). /FTId = VAR_013587. |
| 941-944 | KDGL -> RMGC |
| 986 | Y -> H |
| 1074 | R -> P |
| 1142 | G -> D |
| 1218 | M -> W |
| 1758 | T -> A |
| 1786 | S -> N |

The following GO Annotation(s) apply to the previously known protein. The following annotation(s) were found: cartilage condensation; vision; hearing; cell-cell adhesion; extracellular matrix organization and biogenesis, which are annotation(s) related to Biological Process; extracellular matrix structural protein; extracellular matrix protein, adhesive, which are annotation(s) related to Molecular Function; and extracellular matrix; collagen; collagen type XI, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HUMCA1XIA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 32 refer to weighted expression of ESTs in each category, as "parts per million" (ratio of the expression of ESTs for a particular cluster to the expression of all ESTs in that category, according to parts per million).

Figure 32:
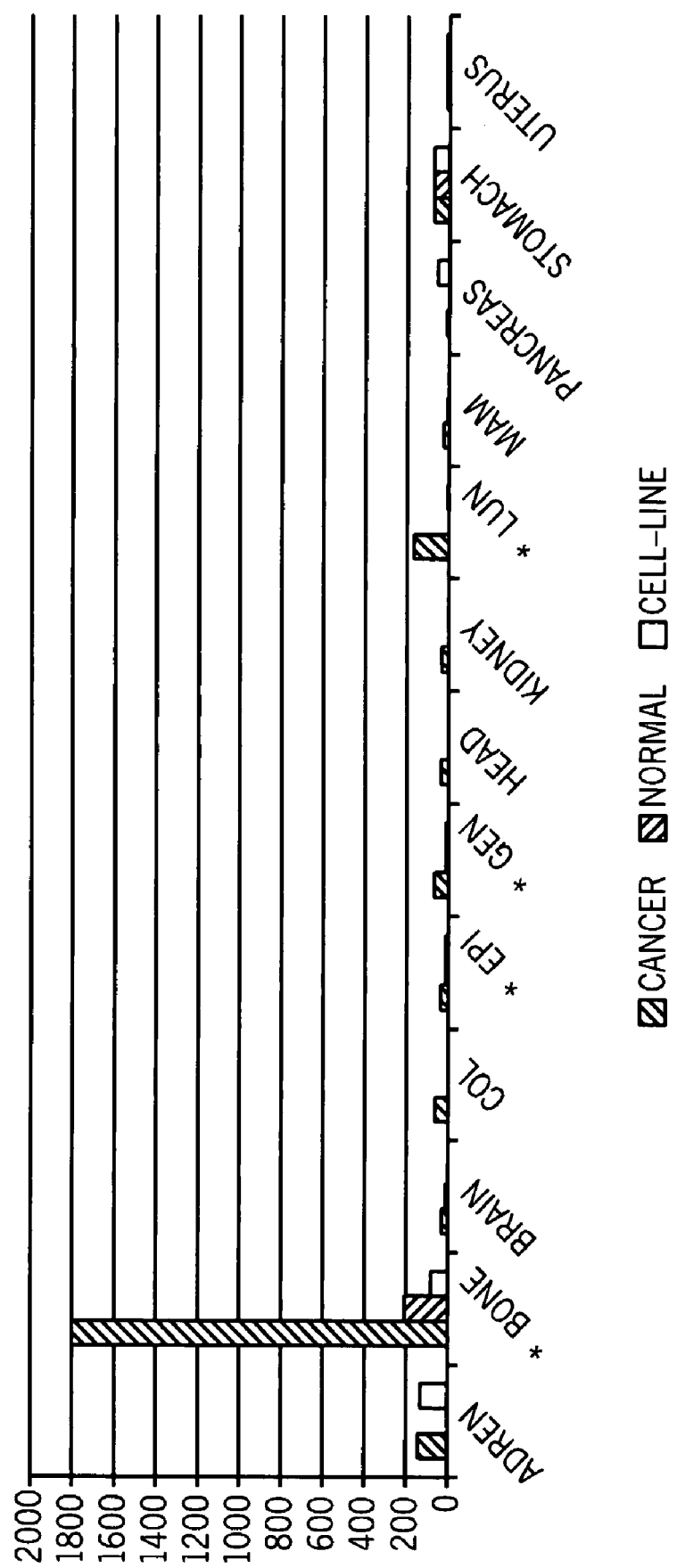
FIG. 32 is a histogram showing Cancer and cell-line vs. normal tissue expression for Cluster HUMCA1XIA, demonstrating overexpression in bone malignant tumors, epithelial malignant tumors, a mixture of malignant tumors from different tissues and lung malignant tumors.

Overall, the following results were obtained as shown with regard to the histograms in FIG. 32 and Table 802. This cluster is overexpressed (at least at a minimum level) in the following pathological conditions: bone malignant tumors, epithelial malignant tumors, a mixture of malignant tumors from different tissues and lung malignant tumors.

TABLE 802

Normal tissue distribution

| Name of Tissue | Number |
|---|---|
| adrenal | 0 |
| bone | 207 |
| brain | 13 |
| colon | 0 |
| epithelial | 11 |
| general | 11 |
| head and neck | 0 |
| kidney | 0 |

TABLE 802-continued

Normal tissue distribution

| Name of Tissue | Number |
|---|---|
| lung | 0 |
| breast | 8 |
| pancreas | 0 |
| stomach | 73 |
| uterus | 9 |

TABLE 803

P values and ratios for expression in cancerous tissue

| Name of Tissue | P1 | P2 | SP1 | R3 | SP2 | R4 |
|---|---|---|---|---|---|---|
| adrenal | 4.2e−01 | 1.9e−01 | 9.6e−02 | 3.4 | 8.2e−02 | 3.6 |
| bone | 2.4e−01 | 6.3e−01 | 7.7e−10 | 4.3 | 5.3e−03 | 1.6 |
| brain | 5.0e−01 | 6.9e−01 | 1.8e−01 | 2.1 | 4.2e−01 | 1.3 |
| colon | 1.3e−02 | 2.9e−02 | 2.4e−01 | 3.0 | 3.5e−01 | 2.4 |
| epithelial | 3.9e−04 | 3.2e−03 | 1.3e−03 | 2.3 | 1.8e−02 | 1.7 |
| general | 5.6e−05 | 1.6e−03 | 9.5e−17 | 4.5 | 1.1e−09 | 2.8 |
| head and neck | 1.2e−01 | 2.1e−01 | 1 | 1.3 | 1 | 1.1 |
| kidney | 6.5e−01 | 7.2e−01 | 3.4e−01 | 2.4 | 4.9e−01 | 1.9 |
| lung | 5.3e−02 | 9.1e−02 | 5.5e−05 | 7.3 | 5.0e−03 | 4.0 |
| breast | 4.3e−01 | 5.6e−01 | 6.9e−01 | 1.4 | 8.2e−01 | 1.1 |
| pancreas | 3.3e−01 | 1.8e−01 | 4.2e−01 | 2.4 | 1.5e−01 | 3.7 |
| stomach | 5.0e−01 | 6.1e−01 | 6.9e−01 | 1.0 | 6.7e−01 | 0.8 |
| Uterus | 7.1e−01 | 7.0e−01 | 6.6e−01 | 1.1 | 6.4e−01 | 1.1 |

As noted above, cluster HUMCA1XIA features 4 transcript(s), which were listed in Table 798 above. These transcript(s) encode for protein(s) which are variant(s) of protein Collagen alpha 1 (SEQ ID NO:1446). A description of each variant protein according to the present invention is now provided.

Variant protein HUMCA1XIA_P14 (SEQ ID NO:1372) according to the present invention has an amino acid sequence as given at the end of the application; it is encoded by transcript(s) HUMCA1XIA_T16 (SEQ ID NO:99). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison report between HUMCA1XIA_P14 (SEQ ID NO:1372) and CA1B_HUMAN_V5 (SEQ ID NO:1447):

1. An isolated chimeric polypeptide encoding for HUMCA1XIA_P14 (SEQ ID NO:1372), comprising a first amino acid sequence being at least 90% homologous to MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDH TGKPAPEDYPLFRTVNIADGKWHRVAISVEKKTVTMIVDCKKKTTKPLDRSERAIVDTNGITVFGTRILDE EVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSE DTLYENKEIDGRDSDLLVDGDLGEYDFYEYKEYEDKPTSPPNEEFGPGVPAETDITETSINGHGAYGEKGQ KGEPAVVEPGMLVEGPPGPAGPAGIMGPPGLQGPTGPPGD- PGDRGPPGRPGLPGADGLPGPPGTMLMLPF RYG-GDGSKGPTISAQEAQAQAILQQARIALRGPPGPMGLT-GRPGPVGGPGSSGAKGESGDPGPQGPRGVQ GPPGPTGKPGKRGRPGADGGRGMPGEP-GAKGDRGFDGLPGLPGDKGHRGERGPQG-PPGPPGDDGMRGE DGEIGPRGLPGEAGPRGLLG-PRGTPGAPGQPGMAGVDGPPGPKGNMGPQGEPGPP-GQQGNPGPQGLPGPQ GPIGPPGEKGPQGKPGLAGLP-GADGPPGHPGKEGQSGEKGALGPPGPQG-PIGYPGPRGVKGADGVRGLKG SKGEKGEDGFPG-FKGDMGLKGDRGEVGQIGPRGEDGPEGPKGRAGPT-GDPGPSGQAGEKGKLGVPGLPG YPGRQGPKGSTGF-PGFPGANGEKGARGVAGKPGPRGQRGPT-GPRGSRGARGPTGKPGPKGTSGGDGPPGP PGERG-PQGPQGPVGFPGPKGPPGPPGKDGLPGHPGQRGETG-FQGKTGPPGPGGVVGPQGPTGETGPIGERG HPGPPG-PPGEQGLPGAAGKEGAKGDPGPQGIS-GKDGPAGLRGFPGERGLPGAQ-GAPGLKGGEGPQGPPGP V corresponding to amino acids 1-1056 of CA1B_HUMAN_V5 (SEQ ID NO:1447), which also corresponds to amino acids 1-1056 of HUMCA1XIA_P14 (SEQ ID NO:1372), and a second amino acid sequence being at least 70%, optionally at least 80%, preferably at least 85%, more preferably at least 90% and most preferably at least 95% homologous to a polypeptide having the sequence VSMMIINSQTIMVVNYSSSFITLML (SEQ ID NO: 256) corresponding to amino acids 1057-1081 of HUMCA1XIA_P14 (SEQ ID NO:1372), wherein said first amino acid sequence and second amino acid sequence are contiguous and in a sequential order.

2. An isolated polypeptide encoding for a tail of HUMCA1XIA_P14 (SEQ ID NO:1372), comprising a polypeptide being at least 70%, optionally at least about 80%, preferably at least about 85%, more preferably at least about 90% and most preferably at least about 95% homologous to the sequence VSMMIINSQTIMVVNYSSSFITLML (SEQ ID NO: 256) in HUMCA1XIA_P14 (SEQ ID NO:1372).

It should be noted that the known protein sequence (CA1B_HUMAN (SEQ ID NO:1446)) has one or more changes than the sequence given at the end of the application and named as being the amino acid sequence for CA1B_HUMAN_V5 (SEQ ID NO:1447). These changes were previously known to occur and are listed in the table below.

TABLE 804

Changes to CA1B_HUMAN_V5 (SEQ ID NO:1447)

| SNP position(s) on amino acid sequence | Type of change |
|---|---|
| 987 | conflict |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P14 (SEQ ID NO:1372) also has the following non-silent SNPs (Single Nucleotide Polymorphisms) as listed in Table 805, (given according to their position(s) on the amino acid sequence, with the alternative amino acid(s) listed; the last column indicates whether the SNP is known or not; the presence of known SNPs in variant protein HUMCA1XIA_P14 (SEQ ID NO:1372) sequence provides support for the deduced sequence of this variant protein according to the present invention).

TABLE 805

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |
| 832 | G -> * | Yes |
| 986 | H -> Y | Yes |
| 1061 | I -> M | Yes |
| 1070 | V -> A | Yes |

Variant protein HUMCA1XIA_P14 (SEQ ID NO:1372) is encoded by the following transcript(s): HUMCA1XIA_T16 (SEQ ID NO:99), for which the sequence(s) is/are given at the end of the application. The coding portion of transcript HUMCA1XIA_T16 (SEQ ID NO:99) is shown in bold; this coding portion starts at position 319 and ends at position 3561. The transcript also has the following SNPs as listed in Table 806 (given according to their position on the nucleotide sequence, with the alternative nucleic acid listed; the last column indicates whether the SNP is known or not; the presence of known SNPs in variant protein HUMCA1XIA_P14 (SEQ ID NO:1372) sequence provides support for the deduced sequence of this variant protein according to the present invention).

TABLE 806

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1993 | G -> A | Yes |
| 2812 | G -> T | Yes |
| 3274 | C -> T | Yes |
| 3282 | C -> T | Yes |
| 3501 | A -> G | Yes |
| 3527 | T -> C | Yes |

Variant protein HUMCA1XIA_P15 (SEQ ID NO:1373) according to the present invention has an amino acid sequence as given at the end of the application; it is encoded by transcript(s) HUMCA1XIA_T17 (SEQ ID NO:100). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison report between HUMCA1XIA_P15 (SEQ ID NO:1373) and CA1B_HUMAN (SEQ ID NO:1446):

1. An isolated chimeric polypeptide encoding for HUMCA1XIA_P15 (SEQ ID NO:1373), comprising a first amino acid sequence being at least 90% homologous to MEP-WSSRWKTKRWLWDFTVTTLALTFLFQAREVRGAAP-VDVLKALDFHNSPEGISKTTGFCTNRKNSKG SDTAYRVSKQAQLSAPTKQLFPGGTFPEDFSILFTV-
KPKKGIQSFLLSIYNEHGIQQIGVEVGRSPVFLFEDH
TGKPAPEDYPLFRTVNIADGKWHRVAISVEKKTVTM-
IVDCKKKTTKPLDRSERAIVDTNGITVFGTRILDE
EVFEGDIQQFLITGDPKAAYDYCEHYSPDCDSSAP-
KAAQAQEPQIDEYAPEDIIEYDYEYGEAEYKEAESVT
EGPTVTEETIAQTEANIVDDFQEYNYGTMESYQTE-
APRHVSGTNEPNPVEEIFTEEYLTGEDYDSQRKNSE
DTLYENKEIDGRDSDLLVDGDLGEYD-
FYEYKEYEDKPTSPPNEEFGPGVPAET-
DITETSINGHGAYGEKGQ KGEPAVVEPGMLVEGPPG-
PAGPAGIMGPPGLQGPTGPPGDPGDRGPPGRPGLPGA-
DGLPGPPGTMLMLPF RYGGDGSKGPTI-
SAQEAQAQAILQQARIALRGPPGPMGLT-
GRPGPVGGPGSSGAKGESGDPGPQGPRGVQ
GPPGPTGKPGKRGRPGADGGRGMPGEP-
GAKGDRGFDGLPGLPGDKGHRGERGPQG-
PPGPPGDDGMRGE DGEIGPRGLPGEAGPRGLLG-
PRGTPGAPGQPGMAGVDGPPGPKGNMGPQGEPGPP-
GQQGNPGPQGLPGPQ GPIGPPGEK corresponding to amino acids 1-714 of CA1B_HUMAN (SEQ ID NO:1446), which also corresponds to amino acids 1-714 of HUMCA1XIA_P15 (SEQ ID NO:1373), and a second amino acid sequence being at least 70%, optionally at least 80%, preferably at least 85%, more preferably at least 90% and most preferably at least 95% homologous to a polypeptide having the sequence MCCNLSFGILIPLQK (SEQ ID NO: 257) corresponding to amino acids 715-729 of HUMCA1XIA_P15 (SEQ ID NO:1373), wherein said first amino acid sequence and second amino acid sequence are contiguous and in a sequential order.

2. An isolated polypeptide encoding for a tail of HUMCA1XIA_P15 (SEQ ID NO:1373), comprising a polypeptide being at least 70%, optionally at least about 80%, preferably at least about 85%, more preferably at least about 90% and most preferably at least about 95% homologous to the sequence MCCNLSFGILIPLQK (SEQ ID NO: 257) in HUMCA1XIA_P15 (SEQ ID NO:1373).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P15 (SEQ ID NO:1373) also has the following non-silent SNPs (Single Nucleotide Polymorphisms) as listed in Table 807, (given according to their position(s) on the amino acid sequence, with the alternative amino acid(s) listed; the last column indicates whether the SNP is known or not; the presence of known SNPs in variant protein HUMCA1XIA_P15 (SEQ ID NO:1373) sequence provides support for the deduced sequence of this variant protein according to the present invention).

TABLE 807

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |

The glycosylation sites of variant protein HUMCA1XIA_P15 (SEQ ID NO:1373), as compared to the known protein Collagen alpha 1 (SEQ ID NO:1446), are described in Table 808 (given according to their position(s) on the amino acid sequence in the first column; the second column indicates whether the glycosylation site is present in the variant protein; and the last column indicates whether the position is different on the variant protein).

TABLE 808

Glycosylation site(s)

| Position(s) on known amino acid sequence | Present in variant protein? |
|---|---|
| 1640 | no |

Variant protein HUMCA1XIA_P15 (SEQ ID NO:1373) is encoded by the following transcript(s): HUMCA1XIA_T17 (SEQ ID NO:100), for which the sequence(s) is/are given at the end of the application. The coding portion of transcript HUMCA1XIA_T17 (SEQ ID NO:100) is shown in bold; this coding portion starts at position 319 and ends at position 2505. The transcript also has the following SNPs as listed in Table 809 (given according to their position on the nucleotide sequence, with the alternative nucleic acid listed; the last column indicates whether the SNP is known or not; the presence of known SNPs in variant protein HUMCA1XIA_P15 (SEQ ID NO:1373) sequence provides support for the deduced sequence of this variant protein according to the present invention).

TABLE 809

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1993 | G -> A | Yes |
| 2473 | C -> T | Yes |

Variant protein HUMCA1XIA_P16 (SEQ ID NO:1374) according to the present invention has an amino acid sequence as given at the end of the application; it is encoded by transcript(s) HUMCA1XIA_T19 (SEQ ID NO:101). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison report between HUMCA1XIA_P16 (SEQ ID NO:1374) and CA1B_HUMAN (SEQ ID NO:1446):

1. An isolated chimeric polypeptide encoding for HUMCA1XIA_P16 (SEQ ID NO:1374), comprising a first amino acid sequence being at least 90% homologous to MEP-
WSSRWKTKRWLWDFTVTTLALTFLFQAREVRG-
AAPVDVLKALDFHNSPEGISKTTGFCTNRKNSKG
SDTAYRVSKQAQLSAPTKQLFPGGTFPEDFSILFTV-
KPKKGIQSFLLSIYNEHGIQQIGVEVGRSPVFLFEDH
TGKPAPEDYPLFRTVNIADGKWHRVAIS-
VEKKTVTMIVDCKKKTTKPLDRSERAIVDTNGITVF-
GTRILDE EVFEGDIQQFLITGDPKAAYDYCEHYSP- DCDSSAPKAAQAQEPQIDEYAPEDIIEY-DYEYGEAEYKEAESVT EGPTVTEETIAQTEANIVD-DFQEYNYGTMESYQTEAPRHVSGTNEPNPVEEIFTE-EYLTGEDYDSQRKNSE DTLYENKEIDGRDS-DLLVDGDLGEYDFYEYKEYEDKPTSPP-NEEFGPGVPAETDITETSINGHGAYGEKGQ KGEPAVVEPGMLVEGPPGPAGPAGIMGP-PGLQGPTGPPGDPGDRGPPGRPGLPGAD-GLPGPPGTMLMLPF RYGGDGSKGPTI-SAQEAQAQAILQQARIALRGPPGPMGLTGRPGPVGG-PGSSGAKGESGDPGPQGPRGVQ GPPGPTGK-PGKRGRPGADGGRGMPGEPGAKGDRG-FDGLPGLPGDKGHRGERGPQGPPGPPGDDGMRGE DGEIGPRGLPGEA corresponding to amino acids 1-648 of CA1B_HUMAN (SEQ ID NO:1446), which also corresponds to amino acids 1-648 of HUMCA1XIA_P16 (SEQ ID NO:1374), a second amino acid sequence being at least 90% homologous to GMAGVDGPPGPKGNMGPQGEPGP-PGQQGNPGPQGLPGPQGPIGPPGEK corresponding to amino acids 667-714 of CA1B_HUMAN (SEQ ID NO:1446), which also corresponds to amino acids 649-696 of HUMCA1XIA_P116 (SEQ ID NO:1374), and a third amino acid sequence being at least 70%, optionally at least 80%, preferably at least 85%, more preferably at least 90% and most preferably at least 95% homologous to a polypeptide having the sequence VSFSFSLFYKKVIKFACD-KRFVGRHDERKVVKLSLPLYLIYE (SEQ ID NO: 258) corresponding to amino acids 697-738 of HUMCA1XIA_P16 (SEQ ID NO:1374), wherein said first amino acid sequence, second amino acid sequence and third amino acid sequence are contiguous and in a sequential order.

2. An isolated chimeric polypeptide encoding for an edge portion of HUMCA1XIA_P16 (SEQ ID NO:1374), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise AG, having a structure as follows: a sequence starting from any of amino acid numbers 648-x to 648; and ending at any of amino acid numbers 649+((n−2)−x), in which x varies from 0 to n−2.

3. An isolated polypeptide encoding for a tail of HUMCA1XIA_P16 (SEQ ID NO:1374), comprising a polypeptide being at least 70%, optionally at least about 80%, preferably at least about 85%, more preferably at least about 90% and most preferably at least about 95% homologous to the sequence VSFSFSLFYKKVIKFACD-KRFVGRHDERKVVKLSLPLYLIYE (SEQ ID NO: 258) in HUMCA1XIA_P16 (SEQ ID NO:1374).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P16 (SEQ ID NO:1374) also has the following non-silent SNPs (Single Nucleotide Polymorphisms) as listed in Table 810, (given according to their position(s) on the amino acid sequence, with the alternative amino acid(s) listed; the last column indicates whether the SNP is known or not; the presence of known SNPs in variant protein HUMCA1XIA_P16 (SEQ ID NO:1374) sequence provides support for the deduced sequence of this variant protein according to the present invention).

TABLE 810

Amino acid mutations

| SNP position(s) on amino acid sequence | Alternative amino acid(s) | Previously known SNP? |
|---|---|---|
| 8 | W -> G | Yes |
| 46 | D -> E | Yes |
| 559 | G -> S | Yes |

The glycosylation sites of variant protein HUMCA1XIA_P16 (SEQ ID NO:1374), as compared to the known protein Collagen alpha 1 (SEQ ID NO:1446), are described in Table 811 (given according to their position(s) on the amino acid sequence in the first column; the second column indicates whether the glycosylation site is present in the variant protein; and the last column indicates whether the position is different on the variant protein).

TABLE 811

Glycosylation site(s)

| Position(s) on known amino acid sequence | Present in variant protein? |
|---|---|
| 1640 | no |

Variant protein HUMCA1XIA_P16 (SEQ ID NO:1374) is encoded by the following transcript(s): HUMCA1XIA_T19 (SEQ ID NO:101), for which the sequence(s) is/are given at the end of the application. The coding portion of transcript HUMCA1XIA_T19 (SEQ ID NO:101) is shown in bold; this coding portion starts at position 319 and ends at position 2532. The transcript also has the following SNPs as listed in Table 812 (given according to their position on the nucleotide sequence, with the alternative nucleic acid listed; the last column indicates whether the SNP is known or not; the presence of known SNPs in variant protein HUMCA1XIA_P16 (SEQ ID NO:1374) sequence provides support for the deduced sequence of this variant protein according to the present invention).

TABLE 812

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1993 | G -> A | Yes |
| 2606 | C -> A | Yes |
| 2677 | T -> G | Yes |
| 2849 | C -> T | Yes |

Variant protein HUMCA1XIA_P17 (SEQ ID NO:1375) according to the present invention has an amino acid sequence as given at the end of the application; it is encoded by transcript(s) HUMCA1XIA_T20 (SEQ ID NO:102). An alignment is given to the known protein (Collagen alpha 1 (SEQ ID NO:1446)) at the end of the application. One or more alignments to one or more previously published protein sequences are given at the end of the application. A brief description of the relationship of the variant protein according to the present invention to each such aligned protein is as follows:

Comparison report between HUMCA1XIA_P17 (SEQ ID NO:1375) and CA1B_HUMAN (SEQ ID NO:1446):

1. An isolated chimeric polypeptide encoding for HUMCA1XIA_P17 (SEQ ID NO:1375), comprising a first amino acid sequence being at least 90% homologous to MEPWSSRWKTKRWLWDFTVTTLALTFLFQAREVRGAAPVDVKALDFHNSPEGISKTrGFCTNRkNSKG SDTAYRVSKQAQLSAPTKQLFPGGTFPEDFSILFTVKPKKGIQSFLLSIYNEHGIQQIGVEVGRSPVFLFEDH TGKPAPEDYPLFRTVNIADGKWHRVAISVEKKTVTMIVDCKKKTTKPLDRSERAIVDTNGITVFGTRILDE EVFEGDIQQFLITGDPKAAYDYCEHYSPDCDSSAPKAAQAQEPQIDE corresponding to amino acids 1-260 of CA1B_HUMAN (SEQ ID NO:1446), which also corresponds to amino acids 1-260 of HUMCA1XIA_P17 (SEQ ID NO:1375), and a second amino acid sequence being at least 70%, optionally at least 80%, preferably at least 85%, more preferably at least 90% and most preferably at least 95% homologous to a polypeptide having the sequence VRSTRPEKVFVFQ (SEQ ID NO: 259) corresponding to amino acids 261-273 of HUMCA1XIA_P17 (SEQ ID NO:1375), wherein said first amino acid sequence and second amino acid sequence are contiguous and in a sequential order.

2. An isolated polypeptide encoding for a tail of HUMCA1XIA_P17 (SEQ ID NO:1375), comprising a polypeptide being at least 70%, optionally at least about 80%, preferably at least about 85%, more preferably at least about 90% and most preferably at least about 95% homologous to the sequence VRSTRPEKVFVFQ (SEQ ID NO: 259) in HUMCA1XIA_P17 (SEQ ID NO:1375).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCA1XIA_P17 (SEQ ID NO:1375) also has the following non-silent SNPs (Single Nucleotide Polymorphisms) as listed in Table 813, (given according to their position(s) on the amino acid sequence, with the alternative amino acid(s) listed; the last column indicates whether the SNP is known or not; the presence of known SNPs invariant protein HUMCA1XIA_P17 (SEQ ID NO:1375) sequence provides support for the deduced sequence of this variant protein according to the present invention).

TABLE 813

Amino acid mutations

| SNP position(s) on amino acid sequence | Alternative amino acid(s) | Previously known SNP? |
|---|---|---|
| 8 | W -> G | Yes |
| 46 | D -> E | Yes |

The glycosylation sites of variant protein HUMCA1XIA_P17 (SEQ ID NO:1375), as compared to the known protein Collagen alpha 1 (SEQ ID NO:1446), are described in Table 814 (given according to their position(s) on the amino acid sequence in the first column; the second column indicates whether the glycosylation site is present in the variant protein; and the last column indicates whether the position is different on the variant protein).

TABLE 814

Glycosylation site(s)

| Position(s) on known amino acid sequence | Present in variant protein? |
|---|---|
| 1640 | no |

Variant protein HUMCA1XIA_P17 (SEQ ID NO:1375) is encoded by the following transcript(s): HUMCA1XIA_T20 (SEQ ID NO:102), for which the sequence(s) is/are given at the end of the application. The coding portion of transcript HUMCA1XIA_T20 (SEQ ID NO:102) is shown in bold; this coding portion starts at position 319 and ends at position 1137. The transcript also has the following SNPs as listed in Table 815 (given according to their position on the nucleotide sequence, with the alternative nucleic acid listed; the last column indicates whether the SNP is known or not; the presence of known SNPs in variant protein HUMCA1XIA_P17 (SEQ ID NO:1375) sequence provides support for the deduced sequence of this variant protein according to the present invention).

TABLE 815

Nucleic acid SNPs

| SNP position on nucleotide sequence | Alternative nucleic acid | Previously known SNP? |
|---|---|---|
| 157 | A -> G | No |
| 241 | T -> A | Yes |
| 340 | T -> G | Yes |
| 456 | T -> G | Yes |
| 1150 | A -> C | Yes |

As noted above, cluster HUMCA1XIA features 46 segment(s), which were listed in Table 799 above and for which the sequence(s) are given at the end of the application. These segment(s) are portions of nucleic acid sequence(s) which are described herein separately because they are of particular interest. A description of each segment according to the present invention is now provided.

Segment cluster HUMCA1XIA_node_0 (SEQ ID NO:742) according to the present invention is supported by 13 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 816 below describes the starting and ending position of this segment on each transcript.

TABLE 816

Segment location on transcripts

| Transcript name | Segment starting position | Segment ending position |
|---|---|---|
| HUMCA1XIA_T16 (SEQ ID NO:99) | 1 | 424 |
| HUMCA1XIA_T17 (SEQ ID NO:100) | 1 | 424 |
| HUMCA1XIA_T19 (SEQ ID NO:101) | 1 | 424 |
| HUMCA1XIA_T20 (SEQ ID NO:102) | 1 | 424 |

Segment cluster HUMCA1XIA_node_2 (SEQ ID NO:743) according to the present invention is supported by 9 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 817 below describes the starting and ending position of this segment on each transcript.

TABLE 817

Segment location on transcripts

| Transcript name | Segment starting position | Segment ending position |
|---|---|---|
| HUMCA1XIA_T16 (SEQ ID NO:99) | 425 | 592 |
| HUMCA1XIA_T17 (SEQ ID NO:100) | 425 | 592 |
| HUMCA1XIA_T19 (SEQ ID NO:101) | 425 | 592 |
| HUMCA1XIA_T20 (SEQ ID NO:102) | 425 | 592 |

Segment cluster HUMCA1XIA_node_4 (SEQ ID NO:744) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 818 below describes the starting and ending position of this segment on each transcript.

TABLE 818

Segment location on transcripts

| Transcript name | Segment starting position | Segment ending position |
|---|---|---|
| HUMCA1XIA_T16 (SEQ ID NO:99) | 593 | 806 |
| HUMCA1XIA_T17 (SEQ ID NO:100) | 593 | 806 |
| HUMCA1XIA_T19 (SEQ ID NO:101) | 593 | 806 |
| HUMCA1XIA_T20 (SEQ ID NO:102) | 593 | 806 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 819.

TABLE 819

Oligonucleotides related to this segment

| Oligonucleotide name | Overexpressed in cancers | Chip reference |
|---|---|---|
| HUMCA1XIA_0_18_0 (SEQ ID NO:236) | lung malignant tumors | LUN |

Segment cluster HUMCA1XIA_node_6 (SEQ ID NO:745) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 820 below describes the starting and ending position of this segment on each transcript.

TABLE 820

Segment location on transcripts

| Transcript name | Segment starting position | Segment ending position |
|---|---|---|
| HUMCA1XIA_T16 (SEQ ID NO:99) | 807 | 969 |
| HUMCA1XIA_T17 (SEQ ID NO:100) | 807 | 969 |
| HUMCA1XIA_T19 (SEQ ID NO:101) | 807 | 969 |
| HUMCA1XIA_T20 (SEQ ID NO:102) | 807 | 969 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 821.

TABLE 821

Oligonucleotides related to this segment

| Oligonucleotide name | Overexpressed in cancers | Chip reference |
|---|---|---|
| HUMCA1XIA_0_18_0 (SEQ ID NO:236) | lung malignant tumors | LUN |

Segment cluster HUMCA1XIA_node_8 (SEQ ID NO:746) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100), HUMCA1XIA_T19 (SEQ ID NO:101) and HUMCA1XIA_T20 (SEQ ID NO:102). Table 822 below describes the starting and ending position of this segment on each transcript.

TABLE 822

Segment location on transcripts

| Transcript name | Segment starting position | Segment ending position |
|---|---|---|
| HUMCA1XIA_T16 (SEQ ID NO:99) | 970 | 1098 |
| HUMCA1XIA_T17 (SEQ ID NO:100) | 970 | 1098 |
| HUMCA1XIA_T19 (SEQ ID NO:101) | 970 | 1098 |
| HUMCA1XIA_T20 (SEQ ID NO:102) | 970 | 1098 |

Segment cluster HUMCA1XIA_node_9 (SEQ ID NO:747) according to the present invention is supported by 2 libraries. The number of libraries was determined as previously described. This segment can be found in the following transcript(s): HUMCA1XIA_T20 (SEQ ID NO:102). Table 823 below describes the starting and ending position of this segment on each transcript.

TABLE 823

Segment location on transcripts

| Transcript name | Segment starting position | Segment ending position |
|---|---|---|
| HUMCA1XIA_T20 (SEQ ID NO:102) | 1099 | 1271 |

Segment cluster HUMCA1XIA_node_18 (SEQ ID NO:748) according to the present invention is supported by 6 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 824 below describes the starting and ending position of this segment on each transcript.

TABLE 824

Segment location on transcripts

| Transcript name | Segment starting position | Segment ending position |
|---|---|---|
| HUMCA1XIA_T16 (SEQ ID NO:99) | 1309 | 1522 |
| HUMCA1XIA_T17 (SEQ ID NO:100) | 1309 | 1522 |
| HUMCA1XIA_T19 (SEQ ID NO:101) | 1309 | 1522 |

Segment cluster HUMCA1XIA_node_54 (SEQ ID NO:749) according to the present invention is supported by 2 libraries. The number of libraries was determined as previously described. This segment can be found in the following transcript(s): HUMCA1XIA_T19 (SEQ ID NO:101). Table 825 below describes the starting and ending position of this segment on each transcript.

TABLE 825

Segment location on transcripts

| Transcript name | Segment starting position | Segment ending position |
|---|---|---|
| HUMCA1XIA_T19 (SEQ ID NO:101) | 2407 | 2836 |

Segment cluster HUMCA1XIA_node_55 (SEQ ID NO:750) according to the present invention is supported by 4 libraries. The number of libraries was determined as previously described. This segment can be found in the following transcript(s): HUMCA1XIA_T17 (SEQ ID NO:100) and HUMCA1XIA_T19 (SEQ ID NO:101). Table 826 below describes the starting and ending position of this segment on each transcript.

TABLE 826

Segment location on transcripts

| Transcript name | Segment starting position | Segment ending position |
|---|---|---|
| HUMCA1XIA_T17 (SEQ ID NO:100) | 2461 | 2648 |
| HUMCA1XIA_T19 (SEQ ID NO:101) | 2837 | 3475 |

Segment cluster HUMCA1XIA node 92 (SEQ ID NO:751) according to the present invention is supported by 2 libraries. The number of libraries was determined as previously described. This segment can be found in the following transcript(s): HUMCA1XIA_T16 (SEQ ID NO:99). Table 827 below describes the starting and ending position of this segment on each transcript.

TABLE 827

Segment location on transcripts

| Transcript name | Segment starting position | Segment ending position |
|---|---|---|
| HUMCA1XIA_T16 (SEQ ID NO:99) | 3487 | 3615 |

According to an optional embodiment of the present invention, short segments related to the above cluster are also provided. These segments are up to about 120 bp in length, and so are included in a separate description.

Segment cluster HUMCA1XIA_node_11 (SEQ ID NO:752) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 828 below describes the starting and ending position of this segment on each transcript.

TABLE 828

Segment location on transcripts

| Transcript name | Segment starting position | Segment ending position |
|---|---|---|
| HUMCA1XIA_T16 (SEQ ID NO:99) | 1099 | 1215 |
| HUMCA1XIA_T17 (SEQ ID NO:100) | 1099 | 1215 |
| HUMCA1XIA_T19 (SEQ ID NO:101) | 1099 | 1215 |

Segment cluster HUMCA1XIA_node_15 (SEQ ID NO:753) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 829 below describes the starting and ending position of this segment on each transcript.

TABLE 829

Segment location on transcripts

| Transcript name | Segment starting position | Segment ending position |
|---|---|---|
| HUMCA1XIA_T16 (SEQ ID NO:99) | 1216 | 1308 |
| HUMCA1XIA_T17 (SEQ ID NO:100) | 1216 | 1308 |
| HUMCA1XIA_T19 (SEQ ID NO:101) | 1216 | 1308 |

Segment cluster HUMCA1XIA_node_19 (SEQ ID NO:754) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 830 below describes the starting and ending position of this segment on each transcript.

TABLE 830

Segment location on transcripts

| Transcript name | Segment starting position | Segment ending position |
|---|---|---|
| HUMCA1XIA_T16 (SEQ ID NO:99) | 1523 | 1563 |
| HUMCA1XIA_T17 (SEQ ID NO:100) | 1523 | 1563 |
| HUMCA1XIA_T19 (SEQ ID NO:101) | 1523 | 1563 |

Segment cluster HUMCA1XIA_node_21 (SEQ ID NO:755) according to the present invention is supported by 2 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 831 below describes the starting and ending position of this segment on each transcript.

TABLE 831

Segment location on transcripts

| Transcript name | Segment starting position | Segment ending position |
|---|---|---|
| HUMCA1XIA_T16 (SEQ ID NO:99) | 1564 | 1626 |
| HUMCA1XIA_T17 (SEQ ID NO:100) | 1564 | 1626 |
| HUMCA1XIA_T19 (SEQ ID NO:101) | 1564 | 1626 |

Segment cluster HUMCA1XIA_node_23 (SEQ ID NO:756) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 832 below describes the starting and ending position of this segment on each transcript.

TABLE 832

Segment location on transcripts

| Transcript name | Segment starting position | Segment ending position |
|---|---|---|
| HUMCA1XIA_T16 (SEQ ID NO:99) | 1627 | 1668 |
| HUMCA1XIA_T17 (SEQ ID NO:100) | 1627 | 1668 |
| HUMCA1XIA_T19 (SEQ ID NO:101) | 1627 | 1668 |

Segment cluster HUMCA1XIA_node_25 (SEQ ID NO:757) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 833 below describes the starting and ending position of this segment on each transcript.

TABLE 833

Segment location on transcripts

| Transcript name | Segment starting position | Segment ending position |
|---|---|---|
| HUMCA1XIA_T16 (SEQ ID NO:99) | 1669 | 1731 |
| HUMCA1XIA_T17 (SEQ ID NO:100) | 1669 | 1731 |
| HUMCA1XIA_T19 (SEQ ID NO:101) | 1669 | 1731 |

Segment cluster HUMCA1XIA_node_27 (SEQ ID NO:758) according to the present invention is supported by 2 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 834 below describes the starting and ending position of this segment on each transcript.

TABLE 834

Segment location on transcripts

| Transcript name | Segment starting position | Segment ending position |
|---|---|---|
| HUMCA1XIA_T16 (SEQ ID NO:99) | 1732 | 1806 |
| HUMCA1XIA_T17 (SEQ ID NO:100) | 1732 | 1806 |
| HUMCA1XIA_T19 (SEQ ID NO:101) | 1732 | 1806 |

Segment cluster HUMCA1XIA_node_29 (SEQ ID NO:759) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 835 below describes the starting and ending position of this segment on each transcript.

TABLE 835

Segment location on transcripts

| Transcript name | Segment starting position | Segment ending position |
|---|---|---|
| HUMCA1XIA_T16 (SEQ ID NO:99) | 1807 | 1890 |
| HUMCA1XIA_T17 (SEQ ID NO:100) | 1807 | 1890 |
| HUMCA1XIA_T19 (SEQ ID NO:101) | 1807 | 1890 |

Segment cluster HUMCA1XIA_node_31 (SEQ ID NO:760) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 836 below describes the starting and ending position of this segment on each transcript.

TABLE 836

Segment location on transcripts

| Transcript name | Segment starting position | Segment ending position |
|---|---|---|
| HUMCA1XIA_T16 (SEQ ID NO:99) | 1891 | 1947 |
| HUMCA1XIA_T17 (SEQ ID NO:100) | 1891 | 1947 |
| HUMCA1XIA_T19 (SEQ ID NO:101) | 1891 | 1947 |

Segment cluster HUMCA1XIA_node_33 (SEQ ID NO:761) according to the present invention is supported by 3 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 837 below describes the starting and ending position of this segment on each transcript.

TABLE 837

Segment location on transcripts

| Transcript name | Segment starting position | Segment ending position |
|---|---|---|
| HUMCA1XIA_T16 (SEQ ID NO:99) | 1948 | 2001 |
| HUMCA1XIA_T17 (SEQ ID NO:100) | 1948 | 2001 |
| HUMCA1XIA_T19 (SEQ ID NO:101) | 1948 | 2001 |

Segment cluster HUMCA1XIA_node_35 (SEQ ID NO:762) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 838 below describes the starting and ending position of this segment on each transcript.

TABLE 838

Segment location on transcripts

| Transcript name | Segment starting position | Segment ending position |
|---|---|---|
| HUMCA1XIA_T16 (SEQ ID NO:99) | 2002 | 2055 |
| HUMCA1XIA_T17 (SEQ ID NO:100) | 2002 | 2055 |
| HUMCA1XIA_T19 (SEQ ID NO:101) | 2002 | 2055 |

Segment cluster HUMCA1XIA_node_37 (SEQ ID NO:763) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 839 below describes the starting and ending position of this segment on each transcript.

TABLE 839

Segment location on transcripts

| Transcript name | Segment starting position | Segment ending position |
|---|---|---|
| HUMCA1XIA_T16 (SEQ ID NO:99) | 2056 | 2109 |
| HUMCA1XIA_T17 (SEQ ID NO:100) | 2056 | 2109 |
| HUMCA1XIA_T19 (SEQ ID NO:101) | 2056 | 2109 |

Segment cluster HUMCA1XIA_node_39 (SEQ ID NO:764) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 840 below describes the starting and ending position of this segment on each transcript.

TABLE 840

Segment location on transcripts

| Transcript name | Segment starting position | Segment ending position |
|---|---|---|
| HUMCA1XIA_T16 (SEQ ID NO:99) | 2110 | 2163 |
| HUMCA1XIA_T17 (SEQ ID NO:100) | 2110 | 2163 |
| HUMCA1XIA_T19 (SEQ ID NO:101) | 2110 | 2163 |

Segment cluster HUMCA1XIA_node_41 (SEQ ID NO:765) according to the present invention is supported by 4 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 841 below describes the starting and ending position of this segment on each transcript.

TABLE 841

Segment location on transcripts

| Transcript name | Segment starting position | Segment ending position |
|---|---|---|
| HUMCA1XIA_T16 (SEQ ID NO:99) | 2164 | 2217 |
| HUMCA1XIA_T17 (SEQ ID NO:100) | 2164 | 2217 |
| HUMCA1XIA_T19 (SEQ ID NO:101) | 2164 | 2217 |

Segment cluster HUMCA1XIA_node_43 (SEQ ID NO:766) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO: 100) and HUMCA1XIA_T19 (SEQ ID NO:101). Table 842 below describes the starting and ending position of this segment on each transcript.

TABLE 842

Segment location on transcripts

| Transcript name | Segment starting position | Segment ending position |
|---|---|---|
| HUMCA1XIA_T16 (SEQ ID NO:99) | 2218 | 2262 |
| HUMCA1XIA_T17 (SEQ ID NO:100) | 2218 | 2262 |
| HUMCA1XIA_T19 (SEQ ID NO:101) | 2218 | 2262 |

Segment cluster HUMCA1XIA_node_45 (SEQ ID NO:767) according to the present invention is supported by 4 libraries. The number of libraries was determined as previously described. This segment can be found in the following transcript(s): HUMCA1XIA_T16 (SEQ ID NO:99) and HUMCA1XIA_T17 (SEQ ID NO:100). Table 843 below describes the starting and ending position of this segment on each transcript.

TABLE 843

Segment location on transcripts

| Transcript name | Segment starting position | Segment ending position |
|---|---|---|
| HUMCA1XIA_T16 (SEQ ID NO:99) | 2263 | 2316 |
| HUMCA1XIA_T17 (SEQ ID NO:100) | 2263 | 2316 |

Segment cluster HUMCA1XIA_node_47 (SEQ ID NO:768) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 844 below describes the starting and ending position of this segment on each transcript.

TABLE 844

Segment location on transcripts

| Transcript name | Segment starting position | Segment ending position |
|---|---|---|
| HUMCA1XIA_T16 (SEQ ID NO:99) | 2317 | 2361 |
| HUMCA1XIA_T17 (SEQ ID NO:100) | 2317 | 2361 |
| HUMCA1XIA_T19 (SEQ ID NO:101) | 2263 | 2307 |

Segment cluster HUMCA1XIA_node_49 (SEQ ID NO:769) according to the present invention is supported by 5 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 845 below describes the starting and ending position of this segment on each transcript.

TABLE 845

Segment location on transcripts

| Transcript name | Segment starting position | Segment ending position |
|---|---|---|
| HUMCA1XIA_T16 (SEQ ID NO:99) | 2362 | 2415 |
| HUMCA1XIA_T17 (SEQ ID NO:100) | 2362 | 2415 |
| HUMCA1XIA_T19 (SEQ ID NO:101) | 2308 | 2361 |

Segment cluster HUMCA1XIA_node_51 (SEQ ID NO:770) according to the present invention is supported by 7 libraries. The number of libraries was determined as previously described. This segment can be found in the following transcript(s): HUMCA1XIA_T16 (SEQ ID NO:99), HUMCA1XIA_T17 (SEQ ID NO:100) and HUMCA1XIA_T19 (SEQ ID NO:101). Table 846 below describes the starting and ending position of this segment on each transcript.

TABLE 846

Segment location on transcripts

| Transcript name | Segment starting position | Segment ending position |
|---|---|---|
| HUMCA1XIA_T16 (SEQ ID NO:99) | 2416 | 2460 |
| HUMCA1XIA_T17 (SEQ ID NO:100) | 2416 | 2460 |
| HUMCA1XIA_T19 (SEQ ID NO:101) | 2362 | 2406 |

Segment cluster HUMCA1XIA_node_57 (SEQ ID NO:771) according to the present invention is supported by 4 libraries. The number of libraries was determined as previously described. This segment can be found in the following transcript(s): HUMCA1XIA_T16 (SEQ ID NO:99). Table 847 below describes the starting and ending position of this segment on each transcript.

TABLE 847

Segment location on transcripts

| Transcript name | Segment starting position | Segment ending position |
|---|---|---|
| HUMCA1XIA_T16 (SEQ ID NO:99) | 2461 | 2514 |

Segment cluster HUMCA1XIA_node_59 (SEQ ID NO:772) according to the present invention is supported by 3 libraries. The number of libraries was determined as previously described. This segment can be found in the following transcript(s): HUMCA1XIA_T16 (SEQ ID NO:99). Table 848 below describes the starting and ending position of this segment on each transcript.

TABLE 848

Segment location on transcripts

| Transcript name | Segment starting position | Segment ending position |
|---|---|---|
| HUMCA1XIA_T16 (SEQ ID NO:99) | 12515 | 2559 |

Segment cluster HUMCA1XIA_node_62 (SEQ ID NO:773) according to the present invention is supported by 3 libraries. The number of libraries was determined as previously described. This segment can be found in the following transcript(s): HUMCA1XIA_T16 (SEQ ID NO:99). Table 849 below describes the starting and ending position of this segment on each transcript.

TABLE 849

Segment location on transcripts

| Transcript name | Segment starting position | Segment ending position |
|---|---|---|
| HUMCA1XIA_T16 (SEQ ID NO:99) | 2560 | 2613 |

Segment cluster HUMCA1XIA_node_64 (SEQ ID NO:774) according to the present invention is supported by 4 libraries. The number of libraries was determined as previously described. This segment can be found in the following transcript(s): HUMCA1XIA_T16 (SEQ ID NO:99). Table 850 below describes the starting and ending position of this segment on each transcript.

TABLE 850

Segment location on transcripts

| Transcript name | Segment starting position | Segment ending position |
|---|---|---|
| HUMCA1XIA_T16 (SEQ ID NO:99) | 2614 | 2658 |

Segment cluster HUMCA1XIA_node_66 (SEQ ID NO:775) according to the present invention is supported by 4 libraries. The number of libraries was determined as previously described. This segment can be found in the following transcript(s): HUMCA1XIA_T16 (SEQ ID NO:99). Table 851 below describes the starting and ending position of this segment on each transcript.

TABLE 851

Segment location on transcripts

| Transcript name | Segment starting position | Segment ending position |
|---|---|---|
| HUMCA1XIA_T16 (SEQ ID NO:99) | 2659 | 2712 |

Segment cluster HUMCA1XIA_node_68 (SEQ ID NO:776) according to the present invention is supported by 7 libraries. The number of libraries was determined as previously described. This segment can be found in the following transcript(s): HUMCA1XIA_T16 (SEQ ID NO:99). Table 852 below describes the starting and ending position of this segment on each transcript.

TABLE 852

Segment location on transcripts

| Transcript name | Segment starting position | Segment ending position |
|---|---|---|
| HUMCA1XIA_T16 (SEQ ID NO:99) | 2713 | 2820 |

Segment cluster HUMCA1XIA_node_70 (SEQ ID NO:777) according to the present invention is supported by 6 libraries. The number of libraries was determined as previously described. This segment can be found in the following transcript(s): HUMCA1XIA_T16 (SEQ ID NO:99). Table 853 below describes the starting and ending position of this segment on each transcript.

TABLE 853

Segment location on transcripts

| Transcript name | Segment starting position | Segment ending position |
|---|---|---|
| HUMCA1XIA_T16 (SEQ LID NO:99) | 2821 | 2874 |

Segment cluster HUMCA1XIA_node_72 (SEQ ID NO:778) according to the present invention is supported by 6 libraries. The number of libraries was determined as previously described. This segment can be found in the following transcript(s): HUMCA1XIA_T16 (SEQ ID NO:99). Table 854 below describes the starting and ending position of this segment on each transcript.

TABLE 854

Segment location on transcripts

| Transcript name | Segment starting position | Segment ending position |
|---|---|---|
| HUMCA1XIA_T16 (SEQ ID NO:99) | 2875 | 2928 |

Segment cluster HUMCA1XIA_node_74 (SEQ ID NO:779) according to the present invention is supported by 5 libraries. The number of libraries was determined as previously described. This segment can be found in the following transcript(s): HUMCA1XIA_T16 (SEQ ID NO:99). Table 855 below describes the starting and ending position of this segment on each transcript.

TABLE 855

Segment location on transcripts

| Transcript name | Segment starting position | Segment ending position |
|---|---|---|
| HUMCA1XIA_T16 (SEQ ID NO:99) | 2929 | 2973 |

Segment cluster HUMCA1XIA_node_76 (SEQ ID NO:780) according to the present invention is supported by 6 libraries. The number of libraries was determined as previously described. This segment can be found in the following transcript(s): HUMCA1XIA_T16 (SEQ ID NO:99). Table 856 below describes the starting and ending position of this segment on each transcript.

TABLE 856

Segment location on transcripts

| Transcript name | Segment starting position | Segment ending position |
|---|---|---|
| HUMCA1XIA_T16 (SEQ ID NO:99) | 2974 | 3027 |

Segment cluster HUMCA1XIA_node_78 (SEQ ID NO:782) according to the present invention is supported by 6 libraries. The number of libraries was determined as previously described. This segment can be found in the following transcript(s): HUMCA1XIA_T16 (SEQ ID NO:99). Table 857 below describes the starting and ending position of this segment on each transcript.

TABLE 857

Segment location on transcripts

| Transcript name | Segment starting position | Segment ending position |
|---|---|---|
| HUMCA1XIA_T16 (SEQ ID NO:99) | 3028 | 3072 |

Segment cluster HUMCA1XIA_node_81 (SEQ ID NO:783) according to the present invention is supported by 8 libraries. The number of libraries was determined as previously described. This segment can be found in the following transcript(s): HUMCA1XIA_T16 (SEQ ID NO:99). Table 858 below describes the starting and ending position of this segment on each transcript.

TABLE 858

Segment location on transcripts

| Transcript name | Segment starting position | Segment ending position |
|---|---|---|
| HUMCA1XIA_T16 (SEQ ID NO:99) | 3073 | 3126 |

Segment cluster HUMCA1XIA_node_83 (SEQ ID NO:784) according to the present invention is supported by 7 libraries. The number of libraries was determined as previously described. This segment can be found in the following transcript(s): HUMCA1XIA_T16 (SEQ ID NO:99). Table 859 below describes the starting and ending position of this segment on each transcript.

TABLE 859

Segment location on transcripts

| Transcript name | Segment starting position | Segment ending position |
|---|---|---|
| HUMCA1XIA_T16 (SEQ ID NO:99) | 3127 | 3180 |

Segment cluster HUMCA1XIA_node_85 (SEQ ID NO:785) according to the present invention is supported by 6 libraries. The number of libraries was determined as previously described. This segment can be found in the following transcript(s): HUMCA1XIA_T16 (SEQ ID NO:99). Table 860 below describes the starting and ending position of this segment on each transcript.

TABLE 860

Segment location on transcripts

| Transcript name | Segment starting position | Segment ending position |
|---|---|---|
| HUMCA1XIA_T16 (SEQ ID NO:99) | 3181 | 3234 |

Segment cluster HUMCA1XIA_node_87 (SEQ ID NO:786) according to the present invention is supported by 10 libraries. The number of libraries was determined as previously described. This segment can be found in the following transcript(s): HUMCA1XIA_T16 (SEQ ID NO:99). Table 861 below describes the starting and ending position of this segment on each transcript.

TABLE 861

Segment location on transcripts

| Transcript name | Segment starting position | Segment ending position |
|---|---|---|
| HUMCA1XIA_T16 (SEQ ID NO:99) | 3235 | 3342 |

Segment cluster HUMCA1XIA_node_89 (SEQ ID NO:787) according to the present invention is supported by 9 libraries. The number of libraries was determined as previously described. This segment can be found in the following transcript(s): HUMCA1XIA_T16 (SEQ ID NO:99). Table 862 below describes the starting and ending position of this segment on each transcript.

TABLE 862

Segment location on transcripts

| Transcript name | Segment starting position | Segment ending position |
|---|---|---|
| HUMCA1XIA_T16 (SEQ ID NO:99) | 3343 | 3432 |

Segment cluster HUMCA1XIA_node_91 (SEQ ID NO:788) according to the present invention is supported by 11 libraries. The number of libraries was determined as previously described. This segment can be found in the following transcript(s): HUMCA1XIA_T16 (SEQ ID NO:99). Table 863 below describes the starting and ending position of this segment on each transcript.

TABLE 863

Segment location on transcripts

| Transcript name | Segment starting position | Segment ending position |
|---|---|---|
| HUMCA1XIA_T16 (SEQ ID NO:99) | 3433 | 3486 |

Variant protein alignment to the previously known protein:

Sequence name: CA1B_HUMAN_V5 (SEQ ID NO:1447)

Sequence documentation:

Alignment of: HUMCA1XIA_P14 (SEQ ID NO:1372) x CA1B_HUMAN_V5 (SEQ ID NO:1447) . . .

Alignment segment 1/1:

| | | | |
|---|---|---|---|
| Quality: | 10456.00 | Escore: | 0 |
| Matching length: | 1058 | Total length: | 1058 |
| Matching Percent Similarity: | 99.91 | Matching Percent Identity: | 99.91 |
| Total Percent Similarity: | 99.91 | Total Percent Identity: | 99.91 |
| Gaps: | 0 | | |

Alignment:

```
  1 MEPWSSRWKTKRWLWDFTVTTLALTFLFQAREVRGAAPVDVLKALDFHNS   50
    ||||||||||||||||||||||||||||||||||||||||||||||||||
  1 MEPWSSRWKTKRWLWDFTVTTLALTFLFQAREVRGAAPVDVLKALDFHNS   50

51 PEGISKTTGFCTNRKNSKGSDTAYRVSKQAQLSAPTKQLFPGGTFPEDFS  100
    ||||||||||||||||||||||||||||||||||||||||||||||||||
 51 PEGISKTTGFCTNRKNSKGSDTAYRVSKQAQLSAPTKQLFPGGTFPEDFS  100

101 ILFTVKPKKGIQSFLLSIYNEHGIQQIGVEVGRSPVFLFEDHTGKPAPED  150
    ||||||||||||||||||||||||||||||||||||||||||||||||||
101 ILFTVKPKKGIQSFLLSIYNEHGIQQIGVEVGRSPVFLFEDHTGKPAPED  150

151 YPLFRTVNIADGKWHRVAISVEKKTVTMIVDCKKKTTKPLDRSERAIVDT  200
    ||||||||||||||||||||||||||||||||||||||||||||||||||
151 YPLFRTVNIADGKWHRVAISVEKKTVTMIVDCKKKTTKPLDRSERAIVDT  200

201 NGITVFGTRILDEEVFEGDIQQFLITGDPKAAYDYCEHYSPDCDSSAPKA  250
    ||||||||||||||||||||||||||||||||||||||||||||||||||
201 NGITVFGTRILDEEVFEGDIQQFLITGDPKAAYDYCEHYSPDCDSSAPKA  250

251 AQAQEPQIDEYAPEDIIEYDYEYGEAEYKEAESVTEGPTVTEETIAQTEA  300
    ||||||||||||||||||||||||||||||||||||||||||||||||||
251 AQAQEPQIDEYAPEDIIEYDYEYGEAEYKEAESVTEGPTVTEETIAQTEA  300

301 NIVDDFQEYNYGTMESYQTEAPRHVSGTNEPNPVEEIFTEEYLTGEDYDS  350
    ||||||||||||||||||||||||||||||||||||||||||||||||||
301 NIVDDFQEYNYGTMESYQTEAPRHVSGTNEPNPVEEIFTEEYLTGEDYDS  350

351 QRKNSEDTLYENKEIDGRDSDLLVDGDLGEYDFYEYKEYEDKPTSPPNEE  400
    ||||||||||||||||||||||||||||||||||||||||||||||||||
351 QRKNSEDTLYENKEIDGRDSDLLVDGDLGEYDFYEYKEYEDKPTSPPNEE  400

401 FGPGVPAETDITETSINGHGAYGEKGQKGEPAVVEPGMLVEGPPGPAGPA  450
    ||||||||||||||||||||||||||||||||||||||||||||||||||
401 FGPGVPAETDITETSINGHGAYGEKGQKGEPAVVEPGMLVEGPPGPAGPA  450

451 GIMGPPGLQGPTGPPGDPGDRPPGRPGLPGADGLPGPPGTMLMLPFRYG   500
    ||||||||||||||||||||||||||||||||||||||||||||||||
451 GIMGPPGLQGPTGPPGDPGDRPPGRPGLPGADGLPGPPGTMLMLPFRYG   500

501 GDGSKGPTISAQEAQAQAILQQARIALRGPPGPMGLTGRPGPVGGPGSSG  550
    ||||||||||||||||||||||||||||||||||||||||||||||||||
501 GDGSKGPTISAQEAQAQAILQQARIALRGPPGPMGLTGRPGPVGGPGSSG  550

551 AKGESGDPGPQGPRGVQGPPGPTGKPGKRGRPGADGGRGMPGEPGAKGDR  600
    ||||||||||||||||||||||||||||||||||||||||||||||||||
551 AKGESGDPGPQGPRGVQGPPGPTGKPGKRGRPGADGGRGMPGEPGAKGDR  600

601 GFDGLPGLPGDKGHRGERGPQGPPGPPGDDGMRGEDGEIGPRGLPGEAGP  650
    ||||||||||||||||||||||||||||||||||||||||||||||||||
601 GFDGLPGLPGDKGHRGERGPQGPPGPPGDDGMRGEDGEIGPRGLPGEAGP  650

651 RGLLGPRGTPGAPGQPGMAGVDGPPGPKGNMGPQGEPGPPGQQGNPGPQG  700
    ||||||||||||||||||||||||||||||||||||||||||||||||||
651 RGLLGPRGTPGAPGQPGMAGVDGPPGPKGNMGPQGEPGPPGQQGNPGPQG  700

701 LPGPQGPIGPPGEKGPQGKPGLAGLPGADGPPGHPGKEGQSGEKGALGPP  750
    ||||||||||||||||||||||||||||||||||||||||||||||||||
701 LPGPQGPIGPPGEKGPQGKPGLAGLPGADGPPGHPGKEGQSGEKGALGPP  750

751 GPQGPIGYPGPRGVKGADGVRGLKGSKGEKGEDGFPGFKGDMGLKGDRGE  800
    ||||||||||||||||||||||||||||||||||||||||||||||||||
751 GPQGPIGYPGPRGVKGADGVRGLKGSKGEKGEDGFPGFKGDMGLKGDRGE  800

801 VGQIGPRGEDGPEGPKGRAGPTGDPGPSGQAGEKGKLGVPGLPGYPGRQG  850
    ||||||||||||||||||||||||||||||||||||||||||||||||||
801 VGQIGPRGEDGPEGPKGRAGPTGDPGPSGQAGEKGKLGVPGLPGYPGRQG  850

851 PKGSTGFPGFPGANGEKGARGVAGKPGPRGQRGPTGPRGSRGARGPTGKP  900
    ||||||||||||||||||||||||||||||||||||||||||||||||||
851 PKGSTGFPGFPGANGEKGARGVAGKPGPRGQRGPTGPRGSRGARGPTGKP  900

901 GPKGTSGGDGPGPPGERGPQGPQGPVGFPGPKGPPGPPGKDGLPGHPGQ   950
    ||||||||||||||||||||||||||||||||||||||||||||||||
901 GPKGTSGGDGPGPPGERGPQGPQGPVGFPGPKGPPGPPGKDGLPGHPGQ   950

951 RGETGFQGKTGPPGPGGVVGPQGPTGETGPIGERGHPGPPGPPGEQGLPG 1000
    ||||||||||||||||||||||||||||||||||||||||||||||||||
951 RGETGFQGKTGPPGPGGVVGPQGPTGETGPIGERGHPGPPGPPGEQGLPG 1000

1001 AAGKEGAKGDPGPQGISGKDGPAGLRGFPGERGLPGAQGAPGLKGGEGPQ 1050
     ||||||||||||||||||||||||||||||||||||||||||||||||||
1001 AAGKEGAKGDPGPQGISGKDGPAGLRGFPGERGLPGAQGAPGLKGGEGPQ 1050

1051 GPPGPVVS                                           1058
     |||||| |
1051 GPPGPVGS                                           1058
```

Sequence name: CA1B_HUMAN (SEQ ID NO:1446)

Sequence documentation:

Alignment of: HUMCA1XIA_P15 (SEQ ID NO:1373) x CA1B_HUMAN (SEQ ID NO:1446)

Alignment segment 1/1:

| Quality: | 7073.00 | Escore: | 0 |
|---|---|---|---|
| Matching length: | 714 | Total length: | 714 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence name: CA1B_HUMAN (SEQ ID NO:1446)

Sequence documentation:

Alignment of: HUMCA1XIA_P16 (SEQ ID NO:1374) x CA1B_HUMAN (SEQ ID NO:1446)

Alignment segment 1/1:

| Quality: | 6795.00 | Escore: | 0 |
|---|---|---|---|
| Matching length: | 696 | Total length: | 714 |
| Matching Percent Similarity: | 100.00 | Matching Percent Identity: | 100.00 |
| Total Percent Similarity: | 97.48 | Total Percent Identity: | 97.48 |
| Gaps: | 1 | | |

Alignment:

```
  1 MEPWSSRWKTKRWLWDFTVTTLALTFLFQAREVRGAAPVDVLKALDFHNS   50
    ||||||||||||||||||||||||||||||||||||||||||||||||||
  1 MEPWSSRWKTKRWLWDFTVTTLALTFLFQAREVRGAAPVDVLKALDFHNS   50

51 PEGISKTTGFCTNRKNSKGSDTAYRVSKQAQLSAPTKQLFPGGTFPEDFS  100
    ||||||||||||||||||||||||||||||||||||||||||||||||||
 51 PEGISKTTGFCTNRKNSKGSDTAYRVSKQAQLSAPTKQLFPGGTFPEDFS  100

101 ILFTVKPKKGIQSFLLSIYNEHGIQQIGVEVGRSPVFLFEDHTGKPAPED  150
    ||||||||||||||||||||||||||||||||||||||||||||||||||
101 ILFTVKPKKGIQSFLLSIYNEHGIQQIGVEVGRSPVFLFEDHTGKPAPED  150

151 YPLFRTVNIADGKWHRVAISVEKKTVTMIVDCKKKTTKPLDRSERAIVDT  200
    ||||||||||||||||||||||||||||||||||||||||||||||||||
151 YPLFRTVNIADGKWHRVAISVEKKTVTMIVDCKKKTTKPLDRSERAIVDT  200

201 NGITVFGTRILDEEVFEGDIQQFLITGDPKAAYDYCEHYSPDCDSSAPKA  250
    ||||||||||||||||||||||||||||||||||||||||||||||||||
201 NGITVFGTRILDEEVFEGDIQQFLITGDPKAAYDYCEHYSPDCDSSAPKA  250

251 AQAQEPQIDEYAPEDIIEYDYEYGEAEYKEAESVTEGPTVTEETIAQTEA  300
    ||||||||||||||||||||||||||||||||||||||||||||||||||
251 AQAQEPQIDEYAPEDIIEYDYEYGEAEYKEAESVTEGPTVTEETIAQTEA  300

301 NIVDDFQEYNYGTMESYQTEAPRHVSGTNEPNPVEEIFTEEYLTGEDYDS  350
    ||||||||||||||||||||||||||||||||||||||||||||||||||
301 NIVDDFQEYNYGTMESYQTEAPRHVSGTNEPNPVEEIFTEEYLTGEDYDS  350

351 QRKNSEDTLYENKEIDGRDSDLLVDGDLGEYDFYEYKEYEDKPTSPPNEE  400
    ||||||||||||||||||||||||||||||||||||||||||||||||||
351 QRKNSEDTLYENKEIDGRDSDLLVDGDLGEYDFYEYKEYEDKPTSPPNEE  400

401 FGPGVPAETDITETSINGHGAYGEKGQKGEPAVVEPGMLVEGPPGPAGPA  450
    ||||||||||||||||||||||||||||||||||||||||||||||||||
401 FGPGVPAETDITETSINGHGAYGEKGQKGEPAVVEPGMLVEGPPGPAGPA  450

451 GIMGPPGLQGPTGPPGDPGDRGPPGRPGLPGADGLPGPPGTMLMLPFRYG  500
    ||||||||||||||||||||||||||||||||||||||||||||||||||
451 GIMGPPGLQGPTGPPGDPGDRGPPGRPGLPGADGLPGPPGTMLMLPFRYG  500

501 GDGSKGPTISAQEAQAQAILQQARIALRGPPGPMGLTGRPGPVGGPGSSG  550
    ||||||||||||||||||||||||||||||||||||||||||||||||||
501 GDGSKGPTISAQEAQAQAILQQARIALRGPPGPMGLTGRPGPVGGPGSSG  550

551 AKGESGDPGPQGPRGVQGPPGPTGKPGKRGRPGADGGRGMPGEPGAKGDR  600
    ||||||||||||||||||||||||||||||||||||||||||||||||||
551 AKGESGDPGPQGPRGVQGPPGPTGKPGKRGRPGADGGRGMPGEPGAKGDR  600

601 GFDGLPGLPGDKGHRGERGPQGPPGPPGDDGMRGEDGEIGPRGLPGEAGP  650
    ||||||||||||||||||||||||||||||||||||||||||||||||||
601 GFDGLPGLPGDKGHRGERGPQGPPGPPGDDGMRGEDGEIGPRGLPGEAGP  650

651 RGLLGPRGTPGAPGQPGMAGVDGPPGPKGNMGPQGEPGPPGQQGNPGPQG  700
    ||||||||||||||||||||||||||||||||||||||||||||||||||
651 RGLLGPRGTPGAPGQPGMAGVDGPPGPKGNMGPQGEPGPPGQQGNPGPQG  700

701 LPGPQGPIGPPGEK                                     714
    ||||||||||||||
701 LPGPQGPIGPPGEK                                     714
```

Alignment:

```
  1 MEPWSSRWKTKRWLWDFTVTTLALTFLFQAREVRGAAPVDVLKALDFHNS   50
    ||||||||||||||||||||||||||||||||||||||||||||||||||
  1 MEPWSSRWKTKRWLWDFTVTTLALTFLFQAREVRGAAPVDVLKALDFHNS   50

51 PEGISKTTGFCTNRKNSKGSDTAYRVSKQAQLSAPTKQLFPGGTFPEDFS  100
    ||||||||||||||||||||||||||||||||||||||||||||||||||
 51 PEGISKTTGFCTNRKNSKGSDTAYRVSKQAQLSAPTKQLFPGGTFPEDFS  100

101 ILFTVKPKKGIQSFLLSIYNEHGIQQIGVEVGRSPVFLFEDHTGKPAPED  150
    ||||||||||||||||||||||||||||||||||||||||||||||||||
101 ILFTVKPKKGIQSFLLSIYNEHGIQQIGVEVGRSPVFLFEDHTGKPAPED  150

151 YPLFRTVNIADGKWHRVAISVEKKTVTMIVDCKKKTTKPLDRSERAIVDT  200
    ||||||||||||||||||||||||||||||||||||||||||||||||||
151 YPLFRTVNIADGKWHRVAISVEKKTVTMIVDCKKKTTKPLDRSERAIVDT  200

201 NGITVFGTRILDEEVFEGDIQQFLITGDPKAAYDYCEHYSPDCDSSAPKA  250
    ||||||||||||||||||||||||||||||||||||||||||||||||||
201 NGITVFGTRILDEEVFEGDIQQFLITGDPKAAYDYCEHYSPDCDSSAPKA  250

251 AQAQEPQIDEYAPEDIIEYDYEYGEAEYKEAESVTEGPTVTEETIAQTEA  300
    ||||||||||||||||||||||||||||||||||||||||||||||||||
251 AQAQEPQIDEYAPEDIIEYDYEYGEAEYKEAESVTEGPTVTEETIAQTEA  300

301 NIVDDFQEYNYGTMESYQTEAPRHVSGTNEPNPVEEIFTEEYLTGEDYDS  350
    ||||||||||||||||||||||||||||||||||||||||||||||||||
301 NIVDDFQEYNYGTMESYQTEAPRHVSGTNEPNPVEEIFTEEYLTGEDYDS  350

351 QRKNSEDTLYENKEIDGRDSDLLVDGDLGEYDFYEYKEYEDKPTSPPNEE  400
    ||||||||||||||||||||||||||||||||||||||||||||||||||
351 QRKNSEDTLYENKEIDGRDSDLLVDGDLGEYDFYEYKEYEDKPTSPPNEE  400

401 FGPGVPAETDITETSINGHGAYGEKGQKGEPAVVEPGMLVEGPPGPAGPA  450
    ||||||||||||||||||||||||||||||||||||||||||||||||||
401 FGPGVPAETDITETSINGHGAYGEKGQKGEPAVVEPGMLVEGPPGPAGPA  450

451 GIMGPPGLQGPTGPPGDPGDRGPPGRPGLPGADGLPGPPGTMLMLPFRYG  500
    ||||||||||||||||||||||||||||||||||||||||||||||||||
451 GIMGPPGLQGPTGPPGDPGDRGPPGRPGLPGADGLPGPPGTMLMLPFRYG  500

501 GDGSKGPTISAQEAQAQAILQQARIALRGPPGPMGLTGRPGPVGGPGSSG  550
    ||||||||||||||||||||||||||||||||||||||||||||||||||
501 GDGSKGPTISAQEAQAQAILQQARIALRGPPGPMGLTGRPGPVGGPGSSG  550

551 AKGESGDPGPQGPRGVQGPPGPTGKPGKRGRPGADGGRGMPGEPGAKGDR  600
    ||||||||||||||||||||||||||||||||||||||||||||||||||
551 AKGESGDPGPQGPRGVQGPPGPTGKPGKRGRPGADGGRGMPGEPGAKGDR  600

601 GFDGLPGLPGDKGHRGERGPQGPPGPPGDDGMRGEDGEIGPRGLPGEA..  648
    |||||||||||||||||||||||||||||||||||||||||||||||
601 GFDGLPGLPGDKGHRGERGPQGPPGPPGDDGMRGEDGEIGPRGLPGEAGP  650

649 ................GMAGVDGPPGPKGNMGPQGEPGPPGQQGNPGPQG  682
                    ||||||||||||||||||||||||||||||||||
651 RGLLGPRGTPGAPGQPGMAGVDGPPGPKGNMGPQGEPGPPGQQGNPGPQG  700

683 LPGPQGPIGPPGEK  696
    ||||||||||||||
701 LPGPQGPIGPPGEK  714
```

Sequence name: CA1B_HUMAN (SEQ ID NO:1446)

Sequence documentation:

Alignment of: HUMCA1XIA_P17 (SEQ ID NO:1375) x CA1B_HUMAN (SEQ ID NO:1446)

| | | | |
|---|---|---|---|
| Quality: | 2561.00 | Escore: | 0 |
| Matching length: | 260 | Total length: | 260 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment segment 1/1:

Alignment:

```
  1 MEPWSSRWKTKRWLWDFTVTTLALTFLFQAREVRGAAPVDVLKALDFHNS   50
    ||||||||||||||||||||||||||||||||||||||||||||||||||
  1 MEPWSSRWKTKRWLWDFTVTTLALTFLFQAREVRGAAPVDVLKALDFHNS   50

51 PEGISKTTGFCTNRKNSKGSDTAYRVSKQAQLSAPTKQLFPGGTFPEDFS  100
    ||||||||||||||||||||||||||||||||||||||||||||||||||
 51 PEGISKTTGFCTNRKNSKGSDTAYRVSKQAQLSAPTKQLFPGGTFPEDFS  100
```

```
101 ILFTVKPKKGIQSFLLSIYNEHGIQQIGVEVGRSPVFLFEDHTGKPAPED 150
    |||||||||||||||||||||||||||||||||||||||||||||||||
101 ILFTVKPKKGIQSFLLSIYNEHGIQQIGVEVGRSPVFLFEDHTGKPAPED 150

151 YPLFRTVNIADGKWHRVAISVEKKTVTMIVDCKKKTTKPLDRSERAIVDT 200
    |||||||||||||||||||||||||||||||||||||||||||||||||
151 YPLFRTVNIADGKWHRVAISVEKKTVTMIVDCKKKTTKPLDRSERAIVDT 200

201 NGITVFGTRILDEEVFEGDIQQFLITGDPKAAYDYCEHYSPDCDSSAPKA 250
    |||||||||||||||||||||||||||||||||||||||||||||||||
201 NGITVFGTRILDEEVFEGDIQQFLITGDPKAAYDYCEHYSPDCDSSAPKA 250

251 AQAQEPQIDE 260
    ||||||||||
251 AQAQEPQIDE 260
```

Expression of *Homo Sapiens* Collagen, Type XI, Alpha 1 (COL11A1) HUMCA1X1A Transcripts which are Detectable by Amplicon as Depicted in Sequence Name HUMCA1X1A seg55 (SEQ ID NO:1663) in Normal and Cancerous Lung Tissues Expression of *Homo sapiens* collagen, type XI, alpha 1 (COL11A1) transcripts detectable by or according to seg55, HUMCA1X1A seg55 amplicon (SEQ ID NO:1663) and primers HUMCA1X1A seg55F (SEQ ID NO:1661) and HUMCA1X1A seg55R (SEQ ID NO:1662) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 67:
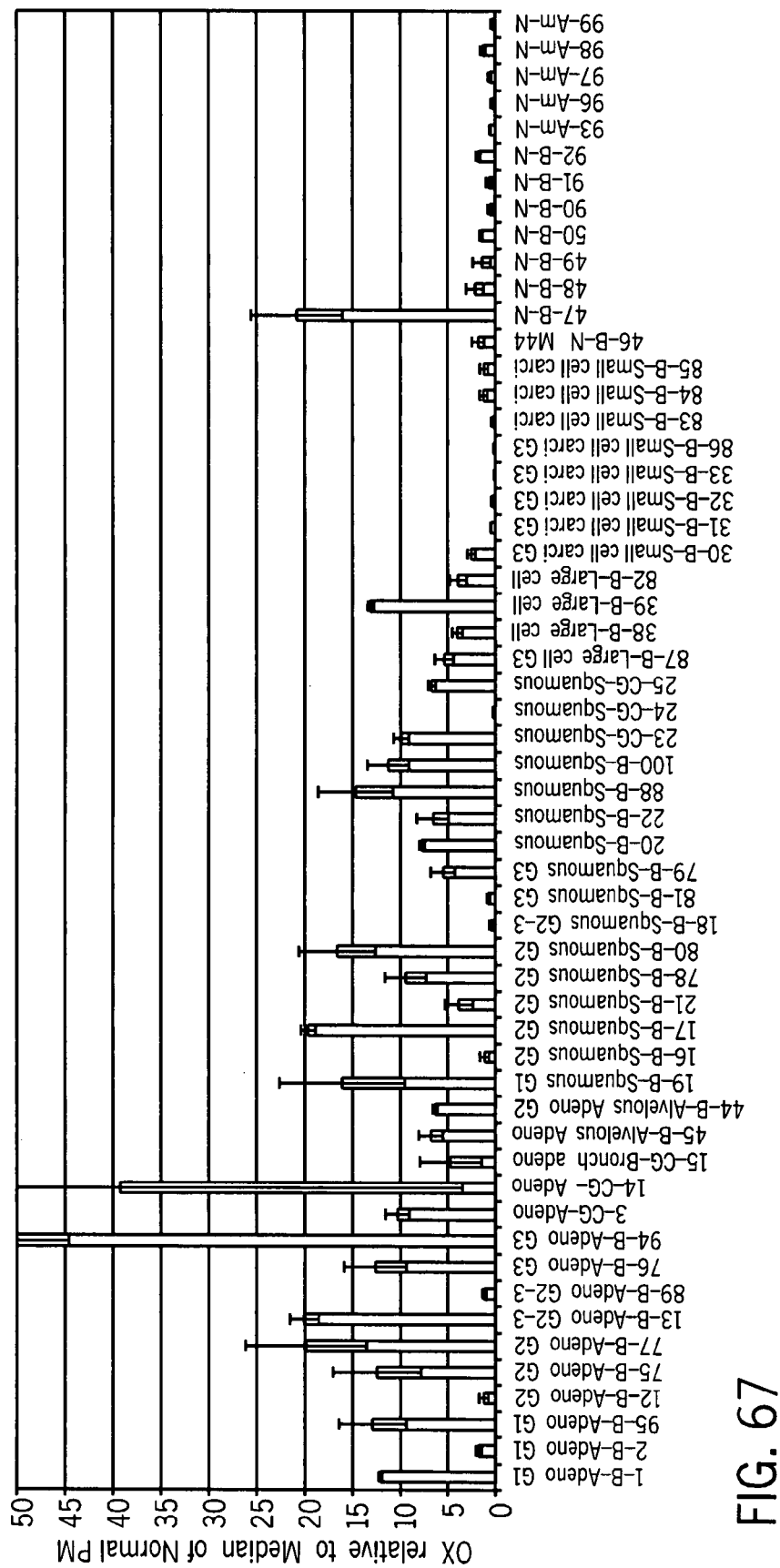
FIG. 67 is a histogram showing over expression of the above-indicated Homo sapiens collagen, type XI, alpha 1 (COL11A1) transcripts which are detectable by amplicon as depicted in sequence name HUMCA1X1A seg55 (SEQ ID NO:1663) in cancerous lung samples relative to the normal samples.

FIG. 67 is a histogram showing over expression of the above-indicated *Homo sapiens* collagen, type XI, alpha 1 (COL11A1) transcripts in cancerous lung samples relative to the normal samples. Values represent the average of duplicate experiments. Error bars indicate the minimal and maximal values obtained.

As is evident from FIG. 67, the expression of *Homo sapiens* collagen, type XI, alpha 1 (COL11A1) transcripts detectable by the above amplicon(s) in cancer samples was significantly higher than in the non-cancerous samples (Sample Nos. 47-50, 90-93, 96-99 Table 2). Notably an over-expression of at least 5 fold was found in 11 out of 15 adenocarcinoma samples, 11 out of 16 squamous cell carcinoma samples, and in 2 out of 4 large cell carcinoma samples.

Primer pairs are also optionally and preferably encompassed within the present invention; for example, for the above experiment, the following primer pair was used as a non-limiting illustrative example only of a suitable primer pair: HUMCA1X1A seg55F forward primer (SEQ ID NO:1661); and HUMCA1X1A seg55R reverse primer (SEQ ID NO:16623).

The present invention also preferably encompasses any amplicon obtained through the use of any suitable primer pair; for example, for the above experiment, the following amplicon was obtained as a non-limiting illustrative example only of a suitable amplicon: HUMCA1X1A seg55 (SEQ ID NO:1663).

Forward primer—HUMCA1X1A seg55F (SEQ ID NO:1661): TTCTCATAGTATTCCATTGATTGGGTA

Reverse primer—HUMCA1X1A seg55R (SEQ ID NO:1662): CACCGGTATGGAGAATAGCGA

Amplicon (SEQ ID NO:1663): TTCTCATAGTATTCCATTGATTGGGTATACCAGGTTCTGTTATACTTTTACTTGGCAGTTGATAGAATAG GTGTAGTTTATACTTTTTCGCTATTCTCCATACCGGTG Description for Cluster T11628

Cluster T11628 features 6 transcript(s) and 25 segment(s) of interest, the names for which are given in Tables 864 and 865, respectively, the sequences themselves are given at the end of the application. The selected protein variants are given in table 866.

TABLE 864

Transcripts of interest

| Transcript name | Sequence ID No. |
| --- | --- |
| T11628_PEA_1_T3 | 103 |
| T11628_PEA_1_T4 | 104 |
| T11628_PEA_1_T5 | 105 |
| T11628_PEA_1_T7 | 106 |
| T11628_PEA_1_T9 | 107 |
| T11628_PEA_1_T11 | 108 |

TABLE 865

Segments of interest

| Segment Name | Sequence ID No. |
| --- | --- |
| T11628_PEA_1_node_7 | 789 |
| T11628_PEA_1_node_11 | 790 |
| T11628_PEA_1_node_16 | 791 |
| T11628_PEA_1_node_22 | 792 |
| T11628_PEA_1_node_25 | 793 |
| T11628_PEA_1_node_31 | 794 |
| T11628_PEA_1_node_37 | 795 |
| T11628_PEA_1_node_0 | 796 |
| T11628_PEA_1_node_4 | 797 |
| T11628_PEA_1_node_9 | 798 |
| T11628_PEA_1_node_13 | 799 |
| T11628_PEA_1_node_14 | 800 |
| T11628_PEA_1_node_17 | 801 |
| T11628_PEA_1_node_18 | 802 |
| T11628_PEA_1_node_19 | 803 |
| T11628_PEA_1_node_24 | 804 |
| T11628_PEA_1_node_27 | 805 |

TABLE 865-continued

Segments of interest

| Segment Name | Sequence ID No. |
| --- | --- |
| T11628_PEA_1_node_28 | 806 |
| T11628_PEA_1_node_29 | 807 |
| T11628_PEA_1_node_30 | 808 |
| T11628_PEA_1_node_32 | 809 |
| T11628_PEA_1_node_33 | 810 |
| T11628_PEA_1_node_34 | 811 |
| T11628_PEA_1_node_35 | 812 |
| T11628_PEA_1_node_36 | 813 |

TABLE 866

Proteins of interest

| Protein Name | Sequence ID No. | Corresponding Transcript(s) |
| --- | --- | --- |
| T11628_PEA_1_P2 | 1376 | T11628_PEA_1_T3 (SEQ ID NO:103) |
| | | T11628_PEA_1_T5 (SEQ ID NO:105) |
| | | T11628_PEA_1_T7 (SEQ ID NO:106) |
| T11628_PEA_1_P5 | 1377 | T11628_PEA_1_T9 (SEQ ID NO:107) |
| T11628_PEA_1_P7 | 1378 | T11628_PEA_1_T11 (SEQ ID NO:108) |
| T11628_PEA_1_P10 | 1379 | T11628_PEA_1_T4 (SEQ ID NO:104) |

These sequences are variants of the known protein Myoglobin (SwissProt accession identifier MYG_HUMAN), SEQ ID NO: 1448, referred to herein as the previously known protein.

Protein Myoglobin (SEQ ID NO:1448) is known or believed to have the following function(s): Serves as a reserve supply of oxygen and facilitates the movement of oxygen within muscles. The sequence for protein Myoglobin is given at the end of the application, as "Myoglobin amino acid sequence". Known polymorphisms for this sequence are as shown in Table 867.

TABLE 867

Amino acid mutations for Known Protein

| SNP position(s) on amino acid sequence | Comment |
| --- | --- |
| 54 | E -> K./FTId=VAR_003180. |
| 133 | K -> N./FTId=VAR_003181. |
| 139 | R -> Q./FTId=VAR_003182. |
| 139 | R -> W./FTId=VAR_003183. |
| 128 | Q -> E |

As noted above, cluster T11628 features 6 transcript(s), which were listed in Table 864 above. These transcript(s) encode for protein(s) which are variant(s) of protein Myoglobin (SEQ ID NO:1448). A description of each variant protein according to the present invention is now provided.

Variant protein T11628_PEA_1_P2 (SEQ ID NO:1376) according to the present invention has an amino acid sequence as given at the end of the application; it is encoded by transcript(s) T11628_PEA_1_T3 (SEQ ID NO:103). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison report between T11628_PEA_1_P2 (SEQ ID NO:1376) and Q8WVH6 (SEQ ID NO:1450):

1. An isolated chimeric polypeptide encoding for T11628_PEA_1_P2 (SEQ ID NO:1376), comprising a first amino acid sequence being at least 70%, optionally at least 80%, preferably at least 85%, more preferably at least 90% and most preferably at least 95% homologous to a polypeptide having the sequence MGLSDGEWQLVLNVWGKVEADIPGHGQEVLIRLFKGHPETLEKFDKFKHLKSEDE (SEQ ID NO:1735) corresponding to amino acids 1-55 of T11628_PEA_1_P2 (SEQ ID NO:1376), and a second amino acid sequence being at least 90% homologous to MKASEDLKKHGATVLTALGGILKKKGHHEAEIKPLAQSHATKHKIPVKYLEFISECIIQVLQSKHPGDFGA DAQGAMNKALELFRKDMASNYKELGFQG corresponding to amino acids 1-99 of Q8WVH6 (SEQ ID NO:1450), which also corresponds to amino acids 56-154 of T11628_PEA_1_P2 (SEQ ID NO:1376), wherein said first amino acid sequence and second amino acid sequence are contiguous and in a sequential order.

2. An isolated polypeptide encoding for a head of T11628_PEA_1_P2 (SEQ ID NO:1376), comprising a polypeptide being at least 70%, optionally at least about 80%, preferably at least about 85%, more preferably at least about 90% and most preferably at least about 95% homologous to the sequence MGLSDGEWQLVLNVWGKVEADIPGHGQEVLIRLFKGHPETLEKFDKFKHLKSEDE (SEQ ID NO:1735) of T11628_PEA_1_P2 (SEQ ID NO:1376).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P2 (SEQ ID NO:1376) also has the following non-silent SNPs (Single Nucleotide Polymorphisms) as listed in Table 868, (given according to their position(s) on the amino acid sequence, with the alternative amino acid(s) listed; the last column indicates whether the SNP is known or not; the presence of known SNPs invariant protein T11628_PEA_1_P2 (SEQ ID NO:1376) sequence provides support for the deduced sequence of this variant protein according to the present invention).

TABLE 868

Amino acid mutations

| SNP position(s) on amino acid sequence | Alternative amino acid(s) | Previously known SNP? |
| --- | --- | --- |
| 26 | G -> | No |
| 44 | F -> | No |
| 92 | Q -> R | No |
| 135 | A -> | No |
| 141 | K -> | No |
| 153 | Q -> | No |

Variant protein T11628_PEA_1_P2 (SEQ ID NO:1376) is encoded by the following transcript(s): T11628_PEA_1_T3 (SEQ ID NO:103), for which the sequence(s) is/are given at the end of the application. The coding portion of transcript T11628_PEA_1_T3 (SEQ ID NO:103) is shown in bold; this coding portion starts at position 220 and ends at position 681. The transcript also has the following SNPs as listed in Table 869 (given according to their position on the nucleotide sequence, with the alternative nucleic acid listed; the last column indicates whether the SNP is known or not; the presence of known SNPs in variant protein T11628_PEA_1_P2 (SEQ ID NO:1376) sequence provides support for the deduced sequence of this variant protein according to the present invention).

TABLE 869

Nucleic acid SNPs

| SNP position(s) on amino acid sequence | Alternative amino acid(s) | Previously known SNP? |
|---|---|---|
| 83 | G -> A | Yes |
| 93 | G -> A | Yes |
| 95 | G -> A | Yes |
| 146 | G -> A | Yes |
| 295 | G -> | No |
| 349 | T -> | No |
| 393 | G -> A | Yes |
| 423 | C -> T | Yes |
| 494 | A -> G | No |
| 498 | G -> A | No |
| 623 | C -> | No |
| 642 | G -> | No |
| 678 | G -> | No |
| 686 | C -> | No |
| 686 | C -> A | No |
| 717 | C -> | No |
| 787 | T -> G | No |
| 820 | G -> T | No |
| 826 | G -> T | No |
| 850 | C -> | No |
| 934 | T -> G | No |
| 975 | A -> G | Yes |
| 1117 | G -> | No |
| 1218 | A -> G | No |

Variant protein T11628_PEA_1_P5 (SEQ ID NO:1377) according to the present invention has an amino acid sequence as given at the end of the application; it is encoded by transcript(s) T11628_PEA_1_T9 (SEQ ID NO:107). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison report between T11628_PEA_1_P5 (SEQ ID NO:1377) and MYG_HUMAN_V1 (SEQ ID NO:1449):

1. An isolated chimeric polypeptide encoding for T11628_PEA_1_P5 (SEQ ID NO:1377), comprising a first amino acid sequence being at least 90% homologous to MKASEDLKKHGATVLTALGGILKKKGH-HEAEIKPLAQSHATKHKIPVKYLE-FISECIIQVLQSKHPGDFGA DAQGAMNKALELFRKD-MASNYKELGFQG corresponding to amino acids 56-154 of MYG_HUMAN_V1 (SEQ ID NO:1449), which also corresponds to amino acids 1-99 of T11628_PEA_1_P5 (SEQ ID NO:1377).

It should be noted that the known protein sequence (MYG_HUMAN (SEQ ID NO:1448)) has one or more changes than the sequence given at the end of the application and named as being the amino acid sequence for MYG_HUMAN_V1 (SEQ ID NO:1449). These changes were previously known to occur and are listed in the table below.

TABLE 870

Changes to MYG_HUMAN_V1 (SEQ ID NO:1449)

| SNP position(s) on amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P5 (SEQ ID NO:1377) also has the following non-silent SNPs (Single Nucleotide Polymorphisms) as listed in Table 871, (given according to their position(s) on the amino acid sequence, with the alternative amino acid(s) listed; the last column indicates whether the SNP is known or not; the presence of known SNPs in variant protein T11628_PEA_1_P5 (SEQ ID NO:1377) sequence provides support for the deduced sequence of this variant protein according to the present invention).

TABLE 871

Amino acid mutations

| SNP position(s) on amino acid sequence | Alternative amino acid(s) | Previously known SNP? |
|---|---|---|
| 37 | Q -> R | No |
| 80 | A -> | No |
| 86 | K -> | No |
| 98 | Q -> | No |

Variant protein T11628_PEA_1_P5 (SEQ ID NO:1377) is encoded by the following transcript(s): T11628_PEA_1_T9 (SEQ ID NO:107), for which the sequence(s) is/are given at the end of the application. The coding portion of transcript T11628_PEA_1_T9 (SEQ ID NO:107) is shown in bold; this coding portion starts at position 211 and ends at position 507. The transcript also has the following SNPs as listed in Table 872 (given according to their position on the nucleotide sequence, with the alternative nucleic acid listed; the last column indicates whether the SNP is known or not; the presence of known SNPs in variant protein T11628_PEA_1_P5 (SEQ ID NO:1377) sequence provides support for the deduced sequence of this variant protein according to the present invention).

TABLE 872

Nucleic acid SNPs

| SNP position on nucleotide sequence | Alternative nucleic acid | Previously known SNP? |
|---|---|---|
| 2 | C -> T | Yes |
| 175 | T -> | No |
| 219 | G -> A | Yes |
| 249 | C -> T | Yes |
| 320 | A -> G | No |
| 324 | G -> A | No |
| 449 | C -> | No |

TABLE 872-continued

Nucleic acid SNPs

| SNP position on nucleotide sequence | Alternative nucleic acid | Previously known SNP? |
|---|---|---|
| 468 | G -> | No |
| 504 | G -> | No |
| 512 | C -> | No |
| 512 | C -> A | No |
| 543 | C -> | No |
| 613 | T -> G | No |
| 646 | G -> T | No |
| 652 | G -> T | No |
| 676 | C -> | No |
| 760 | T -> G | No |
| 801 | A -> G | Yes |
| 943 | G -> | No |
| 1044 | A -> G | No |

Variant protein T11628_PEA_1_P7 (SEQ ID NO:1378) according to the present invention has an amino acid sequence as given at the end of the application; it is encoded by transcript(s) T11628_PEA_1_T11 (SEQ ID NO:108). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison report between T11628_PEA_1_P7 (SEQ ID NO:1378) and MYG_HUMAN_V1 (SEQ ID NO:1449):

1. An isolated chimeric polypeptide encoding for T11628_PEA_1_P7 (SEQ ID NO:1378), comprising a first amino acid sequence being at least 90% homologous to MGLSDGEWQLVLNVWGKVEADIPGH-GQEVLIRLFKGHPETLEKFDKFKHILK-SEDEMKASEDLKKHGATV LTALGGILKKKGHHE-AEIKPLAQSHATKHKIPVKYLEFISECIIQVLQSKHPG-DFGADAQGAMNK corresponding to amino acids 1-134 of MYG_HUMAN_V1 (SEQ ID NO:1449), which also corresponds to amino acids 1-134 of T11628_PEA_1_P7 (SEQ ID NO:1378), and a second amino acid sequence being at least 70%, optionally at least 80%, preferably at least 85%, more preferably at least 90% and most preferably at least 95% homologous to a polypeptide having the sequence G corresponding to amino acids 135-135 of T11628_PEA_1_P7 (SEQ ID NO:1378), wherein said first amino acid sequence and second amino acid sequence are contiguous and in a sequential order.

It should be noted that the known protein sequence (MYG_HUMAN (SEQ ID NO:1448)) has one or more changes than the sequence given at the end of the application and named as being the amino acid sequence for MYG_HUMAN_V1 (SEQ ID NO:1449). These changes were previously known to occur and are listed in the table below.

TABLE 873

Changes to MYG_HUMAN_V1 (SEQ ID NO:1449)

| SNP position(s) on amino acid sequence | Type of change |
|---|---|
| 1 | init_met |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P7 (SEQ ID NO:1378) also has the following non-silent SNPs (Single Nucleotide Polymorphisms) as listed in Table 874, (given according to their position(s) on the amino acid sequence, with the alternative amino acid(s) listed; the last column indicates whether the SNP is known or not; the presence of known SNPs in variant protein T11628_PEA_1_P7 (SEQ ID NO:1378) sequence provides support for the deduced sequence of this variant protein according to the present invention).

TABLE 874

Amino acid mutations

| SNP position(s) on amino acid sequence | Alternative amino acid(s) | Previously known SNP? |
|---|---|---|
| 26 | G -> | No |
| 44 | F -> | No |
| 92 | Q -> R | No |

Variant protein T11628_PEA_1_P7 (SEQ ID NO:1378) is encoded by the following transcript(s): T11628_PEA_1_T11 (SEQ ID NO:108), for which the sequence(s) is/are given at the end of the application. The coding portion of transcript T11628_PEA_1_T11 (SEQ ID NO:108) is shown in bold; this coding portion starts at position 319 and ends at position 723. The transcript also has the following SNPs as listed in Table 875 (given according to their position on the nucleotide sequence, with the alternative nucleic acid listed; the last column indicates whether the SNP is known or not; the presence of known SNPs in variant protein T11628_PEA_1_P7 (SEQ ID NO:1378) sequence provides support for the deduced sequence of this variant protein according to the present invention).

TABLE 875

Nucleic acid SNPs

| SNP position on nucleotide sequence | Alternative nucleic acid | Previously known SNP? |
|---|---|---|
| 394 | G -> | No |
| 448 | T -> | No |
| 492 | G -> A | Yes |
| 522 | C -> T | Yes |
| 593 | A -> G | No |
| 597 | G -> A | No |
| 728 | C -> | No |
| 728 | C -> A | No |
| 759 | C -> | No |
| 829 | T -> G | No |
| 862 | G -> T | No |
| 868 | G -> T | No |
| 892 | C -> | No |
| 976 | T -> G | No |
| 1017 | A -> G | Yes |
| 1159 | G -> | No |
| 1260 | A -> G | No |

Variant protein T11628_PEA_1_P10 (SEQ ID NO:1379) according to the present invention has an amino acid sequence as given at the end of the application; it is encoded by transcript(s) T11628_PEA_1_T4 (SEQ ID NO:104). An alignment is given to the known protein (Myoglobin (SEQ ID NO:1448)) at the end of the application. One or more alignments to one or more previously published protein sequences are given at the end of the application. A brief description of the relationship of the variant protein according to the present invention to each such aligned protein is as follows:

Comparison report between T11628_PEA_1_P10 (SEQ ID NO:1379) and Q8WVH6 (SEQ ID NO:1450):

1. An isolated chimeric polypeptide encoding for T11628_PEA_1_P10 (SEQ ID NO:1379), comprising a first amino acid sequence being at least 70%, optionally at least 80%, preferably at least 85%, more preferably at least 90% and most preferably at least 95% homologous to a polypeptide having the sequence MGLSDGEWQLVLN-VWGKVEADIPGHGQEVLIRLFKGH-PETLEKFDKFKHLKSEDE (SEQ ID NO:1735) corresponding to amino acids 1-55 of T11628_PEA_1_P10 (SEQ ID NO:1379), and a second amino acid sequence being at least 90% homologous to MKASEDLKKHGATVLTALG-GILKKKGHHEAEIKPLAQSHATKH-KIPVKYLEFISECIIQVLQSKHPGDFGA DAQ-GAMNKALELFRKDMASNYKELGFQG corresponding to amino acids 1-99 of Q8WVH6 (SEQ ID NO:1450), which also corresponds to amino acids 56-154 of T11628_PEA_1_P10 (SEQ ID NO:1379), wherein said first amino acid sequence and second amino acid sequence are contiguous and in a sequential order.

2. An isolated polypeptide encoding for a head of T11628_PEA_1_P10 (SEQ ID NO:1379), comprising a polypeptide being at least 70%, optionally at least about 80%, preferably at least about 85%, more preferably at least about 90% and most preferably at least about 95% homologous to the sequence MGLSDGEWQLVLNVWGKVEADIPGH-GQEVLIRLFKGHPETLEKFDKFKHLKSEDE (SEQ ID NO: 1735) of T11628_PEA_1_P10 (SEQ ID NO:1379).

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein T11628_PEA_1_P10 (SEQ ID NO:1379) also has the following non-silent SNPs (Single Nucleotide Polymorphisms) as listed in Table 876, (given according to their position(s) on the amino acid sequence, with the alternative amino acid(s) listed; the last column indicates whether the SNP is known or not; the presence of known SNPs in variant protein T11628_PEA_1_P10 (SEQ ID NO:1379) sequence provides support for the deduced sequence of this variant protein according to the present invention).

TABLE 876

Amino acid mutations

| SNP position(s) on amino acid sequence | Alternative amino acid(s) | Previously known SNP? |
|---|---|---|
| 26 | G -> | No |
| 44 | F -> | No |
| 92 | Q -> R | No |
| 135 | A -> | No |

TABLE 876-continued

Amino acid mutations

| SNP position(s) on amino acid sequence | Alternative amino acid(s) | Previously known SNP? |
|---|---|---|
| 141 | K -> | No |
| 153 | Q -> | No |

Variant protein T11628_PEA_1_P10 (SEQ ID NO:1379) is encoded by the following transcript(s): T11628_PEA_1_T4 (SEQ ID NO:104), for which the sequence(s) is/are given at the end of the application. The coding portion of transcript T11628_PEA_1_T4 (SEQ ID NO:104) is shown in bold; this coding portion starts at position 205 and ends at position 666. The transcript also has the following SNPs as listed in Table 877 (given according to their position on the nucleotide sequence, with the alternative nucleic acid listed; the last column indicates whether the SNP is known or not; the presence of known SNPs in variant protein T11628_PEA_1_P10 (SEQ ID NO:1379) sequence provides support for the deduced sequence of this variant protein according to the present invention).

TABLE 877

Nucleic acid SNPs

| SNP position on nucleotide sequence | Alternative nucleic acid | Previously known SNP? |
|---|---|---|
| 280 | G -> | No |
| 334 | T -> | No |
| 378 | G -> A | Yes |
| 408 | C -> T | Yes |
| 479 | A -> G | No |
| 483 | G -> A | No |
| 608 | C -> | No |
| 627 | G -> | No |
| 663 | G -> | No |
| 671 | C -> | No |
| 671 | C -> A | No |
| 702 | C -> | No |
| 772 | T -> G | No |
| 805 | G -> T | No |
| 811 | G -> T | No |
| 835 | C -> | No |
| 919 | T -> G | No |
| 960 | A -> G | Yes |
| 1102 | G -> | No |
| 1203 | A -> G | No |

As noted above, cluster T11628 features 25 segment(s), which were listed in Table 865 above and for which the sequence(s) are given at the end of the application. These segment(s) are portions of nucleic acid sequence(s) which are described herein separately because they are of particular interest. A description of each segment according to the present invention is now provided.

Segment cluster T11628_PEA_1_node_7 (SEQ ID NO:789) according to the present invention is supported by 9 libraries. The number of libraries was determined as previously described. This segment can be found in the following transcript(s): T11628_PEA_1_T3 (SEQ ID NO:103). Table 878 below describes the starting and ending position of this segment on each transcript.

TABLE 878

Segment location on transcripts

| Transcript name | Segment starting position | Segment ending position |
|---|---|---|
| T11628_PEA_1_T3 (SEQ ID NO:103) | 1 | 211 |

Segment cluster T11628_PEA_1_node_11 (SEQ ID NO:790) according to the present invention is supported by 1 libraries. The number of libraries was determined as previously described. This segment can be found in the following transcript(s): T11628_PEA_1_T5 (SEQ ID NO:105). Table 879 below describes the starting and ending position of this segment on each transcript.

TABLE 879

Segment location on transcripts

| Transcript name | Segment starting position | Segment ending position |
|---|---|---|
| T11628_PEA_1_T5 (SEQ ID NO:105) | 48 | 178 |

Segment cluster T11628_PEA_1_node_16 (SEQ ID NO:791) according to the present invention is supported by 38 libraries. The number of libraries was determined as previously described. This segment can be found in the following transcript(s): T11628_PEA_1_T11 (SEQ ID NO:108). Table 880 below describes the starting and ending position of this segment on each transcript.

TABLE 880

Segment location on transcripts

| Transcript name | Segment starting position | Segment ending position |
|---|---|---|
| T11628_PEA_1_T11 (SEQ ID NO:108) | 1 | 214 |

Segment cluster T11628_PEA_1_node_22 (SEQ ID NO:792) according to the present invention is supported by 1 libraries. The number of libraries was determined as previously described. This segment can be found in the following transcript(s): T11628_PEA_1_T9 (SEQ ID NO:107). Table 881 below describes the starting and ending position of this segment on each transcript.

TABLE 881

Segment location on transcripts

| Transcript name | Segment starting position | Segment ending position |
|---|---|---|
| T11628_PEA_1_T9 (SEQ ID NO:107) | 1 | 140 |

Segment cluster T11628_PEA_1_node_25 (SEQ ID NO:793) according to the present invention is supported by 129 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 882 below describes the starting and ending position of this segment on each transcript.

TABLE 882

Segment location on transcripts

| Transcript name | Segment starting position | Segment ending position |
|---|---|---|
| T11628_PEA_1_T3 (SEQ ID NO:103) | 395 | 537 |
| T11628_PEA_1_T4 (SEQ ID NO:104) | 380 | 522 |
| T11628_PEA_1_T5 (SEQ ID NO:105) | 362 | 504 |
| T11628_PEA_1_T7 (SEQ ID NO:106) | 347 | 489 |
| T11628_PEA_1_T9 (SEQ ID NO:107) | 221 | 363 |
| T11628_PEA_1_T11 (SEQ ID NO:108) | 494 | 636 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 883.

TABLE 883

Oligonucleotides related to this segment

| Oligonucleotide name | Overexpressed in cancers | Chip reference |
|---|---|---|
| T11628_0_9_0 (SEQ ID NO: 237) | lung malignant tumors | LUN |

Segment cluster T11628_PEA_1_node_31 (SEQ ID NO:794) according to the present invention is supported by 137 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 884 below describes the starting and ending position of this segment on each transcript.

TABLE 884

Segment location on transcripts

| Transcript name | Segment starting position | Segment ending position |
|---|---|---|
| T11628_PEA_1_T3 (SEQ ID NO:103) | 702 | 831 |
| T11628_PEA_1_T4 (SEQ ID NO:104) | 687 | 816 |
| T11628_PEA_1_T5 (SEQ ID NO:105) | 669 | 798 |
| T11628_PEA_1_T7 (SEQ ID NO:106) | 654 | 783 |
| T11628_PEA_1_T9 (SEQ ID NO:107) | 528 | 657 |
| T11628_PEA_1_T11 (SEQ ID NO:108) | 744 | 873 |

Segment cluster T11628_PEA_1_node_37 (SEQ ID NO:795) according to the present invention is supported by 99 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 885 below describes the starting and ending position of this segment on each transcript.

TABLE 885

Segment location on transcripts

| Transcript name | Segment starting position | Segment ending position |
|---|---|---|
| T11628_PEA_1_T3 (SEQ ID NO:103) | 1086 | 1225 |
| T11628_PEA_1_T4 (SEQ ID NO:104) | 1071 | 1210 |
| T11628_PEA_1_T5 (SEQ ID NO:105) | 1053 | 1192 |
| T11628_PEA_1_T7 (SEQ ID NO:106) | 1038 | 1177 |
| T11628_PEA_1_T9 (SEQ ID NO:107) | 912 | 1051 |
| T11628_PEA_1_T11 (SEQ ID NO:108) | 1128 | 1267 |

According to an optional embodiment of the present invention, short segments related to the above cluster are also provided. These segments are up to about 120 bp in length, and so are included in a separate description.

Segment cluster T11628_PEA_1_node_0 (SEQ ID NO:796) according to the present invention is supported by 1 libraries. The number of libraries was determined as previously described. This segment can be found in the following transcript(s): T11628_PEA_1_T4 (SEQ ID NO:104). Table 886 below describes the starting and ending position of this segment on each transcript.

TABLE 886

Segment location on transcripts

| Transcript name | Segment starting position | Segment ending position |
|---|---|---|
| T11628_PEA_1_T4 (SEQ ID NO:104) | 1 | 93 |

Segment cluster T11628_PEA_1_node_4 (SEQ ID NO:797) according to the present invention is supported by 2 libraries. The number of libraries was determined as previously described. This segment can be found in the following transcript(s): T11628_PEA_1_T4 (SEQ ID NO:104). Table 887 below describes the starting and ending position of this segment on each transcript.

TABLE 887

Segment location on transcripts

| Transcript name | Segment starting position | Segment ending position |
|---|---|---|
| T11628_PEA_1_T4 (SEQ ID NO:104) | 94 | 196 |

Segment cluster T11628_PEA_1_node_9 (SEQ ID NO:798) according to the present invention is supported by 16 libraries. The number of libraries was determined as previously described. This segment can be found in the following transcript(s): T11628_PEA_1_T5 (SEQ ID NO:105) and T11628_PEA_1_T7 (SEQ ID NO:106). Table 888 below describes the starting and ending position of this segment on each transcript.

TABLE 888

Segment location on transcripts

| Transcript name | Segment starting position | Segment ending position |
|---|---|---|
| T11628_PEA_1_T5 (SEQ ID NO:105) | 1 | 47 |
| T11628_PEA_1_T7 (SEQ ID NO:106) | 1 | 47 |

Segment cluster T11628_PEA_1_node_13 (SEQ ID NO:799) according to the present invention can be found in the following transcript(s): T11628_PEA_1_T7 (SEQ ID NO:106). Table 889 below describes the starting and ending position of this segment on each transcript.

TABLE 889

Segment location on transcripts

| Transcript name | Segment starting position | Segment ending position |
|---|---|---|
| T11628_PEA_1_T7 (SEQ ID NO:106) | 48 | 65 |

Segment cluster T11628_PEA_1_node_14 (SEQ ID NO:800) according to the present invention is supported by 1 libraries. The number of libraries was determined as previously described. This segment can be found in the following transcript(s): T11628_PEA_1_T7 (SEQ ID NO:106). Table 890 below describes the starting and ending position of this segment on each transcript.

TABLE 890

Segment location on transcripts

| Transcript name | Segment starting position | Segment ending position |
|---|---|---|
| T11628_PEA_1_T7 (SEQ ID NO:106) | 66 | 163 |

Segment cluster T11628_PEA_1_node_17 (SEQ ID NO:801) according to the present invention is supported by 55 libraries. The number of libraries was determined as previously described. This segment can be found in the following transcript(s): T11628_PEA_1_T11 (SEQ ID NO:108). Table 891 below describes the starting and ending position of this segment on each transcript.

TABLE 891

Segment location on transcripts

| Transcript name | Segment starting position | Segment ending position |
|---|---|---|
| T11628_PEA_1_T11 (SEQ ID NO:108) | 215 | 310 |

Segment cluster T11628_PEA_1_node_18 (SEQ ID NO:802) according to the present invention is supported by 98 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T11 (SEQ ID NO:108).

Table 892 below describes the starting and ending position of this segment on each transcript.

TABLE 892

Segment location on transcripts

| Transcript name | Segment starting position | Segment ending position |
|---|---|---|
| T11628_PEA_1_T3 (SEQ ID NO:103) | 212 | 289 |
| T11628_PEA_1_T4 (SEQ ID NO:104) | 197 | 274 |
| T11628_PEA_1_T5 (SEQ ID NO:105) | 179 | 256 |
| T11628_PEA_1_T7 (SEQ ID NO:106) | 164 | 241 |
| T11628_PEA_1_T11 (SEQ ID NO:108) | 311 | 388 |

Segment cluster T11628_PEA_1_node_19 (SEQ ID NO:803) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T11 (SEQ ID NO:108). Table 893 below describes the starting and ending position of this segment on each transcript.

TABLE 893

Segment location on transcripts

| Transcript name | Segment starting position | Segment ending position |
|---|---|---|
| T11628_PEA_1_T3 (SEQ ID NO:103) | 290 | 314 |
| T11628_PEA_1_T4 (SEQ ID NO:104) | 275 | 299 |
| T11628_PEA_1_T5 (SEQ ID NO:105) | 257 | 281 |
| T11628_PEA_1_T7 (SEQ ID NO:106) | 242 | 266 |
| T11628_PEA_1_T11 (SEQ ID NO:108) | 389 | 413 |

Segment cluster T11628_PEA_1_node_24 (SEQ ID NO:804) according to the present invention is supported by 112 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 894 below describes the starting and ending position of this segment on each transcript.

TABLE 894

Segment location on transcripts

| Transcript name | Segment starting position | Segment ending position |
|---|---|---|
| T11628_PEA_1_T3 (SEQ ID NO:103) | 315 | 394 |
| T11628_PEA_1_T4 (SEQ ID NO:104) | 300 | 379 |
| T11628_PEA_1_T5 (SEQ ID NO:105) | 282 | 361 |
| T11628_PEA_1_T7 (SEQ ID NO:106) | 267 | 346 |
| T11628_PEA_1_T9 (SEQ ID NO:107) | 141 | 220 |
| T11628_PEA_1_T11 (SEQ ID NO:108) | 414 | 493 |

Segment cluster T11628_PEA_1_node_27 (SEQ ID NO:805) according to the present invention is supported by 119 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 895 below describes the starting and ending position of this segment on each transcript.

TABLE 895

Segment location on transcripts

| Transcript name | Segment starting position | Segment ending position |
|---|---|---|
| T11628_PEA_1_T3 (SEQ ID NO:103) | 538 | 621 |
| T11628_PEA_1_T4 (SEQ ID NO:104) | 523 | 606 |
| T11628_PEA_1_T5 (SEQ ID NO:105) | 505 | 588 |
| T11628_PEA_1_T7 (SEQ ID NO:106) | 490 | 573 |
| T11628_PEA_1_T9 (SEQ ID NO:107) | 364 | 447 |
| T11628_PEA_1_T11 (SEQ ID NO:108) | 637 | 720 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 896

TABLE 896

Oligonucleotides related to this segment

| Oligonucleotide name | Overexpressed in cancers | Chip reference |
|---|---|---|
| T11628_0_9_0 (SEQ ID NO: 237) | lung malignant tumors | LUN |

Segment cluster T11628_PEA_1_node_28 (SEQ ID NO:806) according to the present invention is supported by 115 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7(SEQ ID NO:106) and T11628_PEA_1_T9 (SEQ ID NO:107). Table 897 below describes the starting and ending position of this segment on each transcript.

TABLE 897

Segment location on transcripts

| Transcript name | Segment starting position | Segment ending position |
|---|---|---|
| T11628_PEA_1_T3 (SEQ ID NO:103) | 622 | 650 |
| T11628_PEA_1_T4 (SEQ ID NO:104) | 607 | 635 |
| T11628_PEA_1_T5 (SEQ ID NO:105) | 589 | 617 |
| T11628_PEA_1_T7 (SEQ ID NO:106) | 574 | 602 |
| T11628_PEA_1_T9 (SEQ ID NO:107) | 448 | 476 |

Segment cluster T11628_PEA_1_node_29 (SEQ ID NO:807) according to the present invention is supported by 113 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106) and T11628_PEA_1_T9 (SEQ ID NO:107). Table 898 below describes the starting and ending position of this segment on each transcript.

TABLE 898

Segment location on transcripts

| Transcript name | Segment starting position | Segment ending position |
|---|---|---|
| T11628_PEA_1_T3 (SEQ ID NO:103) | 651 | 678 |
| T11628_PEA_1_T4 (SEQ ID NO:104) | 636 | 663 |
| T11628_PEA_1_T5 (SEQ ID NO:105) | 618 | 645 |
| T11628_PEA_1_T7 (SEQ ID NO:106) | 603 | 630 |
| T11628_PEA_1_T9 (SEQ ID NO:107) | 477 | 504 |

Segment cluster T11628_PEA_1_node_30 (SEQ ID NO:808) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 899 below describes the starting and ending position of this segment on each transcript.

TABLE 899

Segment location on transcripts

| Transcript name | Segment starting position | Segment ending position |
|---|---|---|
| T11628_PEA_1_T3 (SEQ ID NO:103) | 679 | 701 |
| T11628_PEA_1_T4 (SEQ ID NO:104) | 664 | 686 |
| T11628_PEA_1_T5 (SEQ ID NO:105) | 646 | 668 |
| T11628_PEA_1_T7 (SEQ ID NO:106) | 631 | 653 |
| T11628_PEA_1_T9 (SEQ ID NO:107) | 505 | 527 |
| T11628_PEA_1_T11 (SEQ ID NO:108) | 721 | 743 |

Segment cluster T11628_PEA_1_node_32 (SEQ ID NO:809) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 900 below describes the starting and ending position of this segment on each transcript.

TABLE 900

Segment location on transcripts

| Transcript name | Segment starting position | Segment ending position |
|---|---|---|
| T11628_PEA_1_T3 (SEQ ID NO:103) | 832 | 844 |
| T11628_PEA_1_T4 (SEQ ID NO:104) | 817 | 829 |
| T11628_PEA_1_T5 (SEQ ID NO:105) | 799 | 811 |
| T11628_PEA_1_T7 (SEQ ID NO:106) | 784 | 796 |
| T11628_PEA_1_T9 (SEQ ID NO:107) | 658 | 670 |
| T11628_PEA_1_T11 (SEQ ID NO:108) | 874 | 886 |

Segment cluster T11628_PEA_1_node_33 (SEQ ID NO:810) according to the present invention can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 901 below describes the starting and ending position of this segment on each transcript.

TABLE 901

Segment location on transcripts

| Transcript name | Segment starting position | Segment ending position |
|---|---|---|
| T11628_PEA_1_T3 (SEQ ID NO:103) | 845 | 866 |
| T11628_PEA_1_T4 (SEQ ID NO:104) | 830 | 851 |
| T11628_PEA_1_T5 (SEQ ID NO:105) | 812 | 833 |
| T11628_PEA_1_T7 (SEQ ID NO:106) | 797 | 818 |
| T11628_PEA_1_T9 (SEQ ID NO:107) | 671 | 692 |
| T11628_PEA_1_T11 (SEQ ID NO:108) | 887 | 908 |

Segment cluster T11628_PEA_1_node_34 (SEQ ID NO:811) according to the present invention is supported by 122 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 902 below describes the starting and ending position of this segment on each transcript.

TABLE 902

Segment location on transcripts

| Transcript name | Segment starting position | Segment ending position |
|---|---|---|
| T11628_PEA_1_T3 (SEQ ID NO:103) | 867 | 911 |
| T11628_PEA_1_T4 (SEQ ID NO:104) | 852 | 896 |
| T11628_PEA_1_T5 (SEQ ID NO:105) | 834 | 878 |
| T11628_PEA_1_T7 (SEQ ID NO:106) | 819 | 863 |
| T11628_PEA_1_T9 (SEQ ID NO:107) | 693 | 737 |
| T11628_PEA_1_T11 (SEQ ID NO:108) | 909 | 953 |

Segment cluster T11628_PEA_1_node_35 (SEQ ID NO:812) according to the present invention is supported by 126 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 903 below describes the starting and ending position of this segment on each transcript.

TABLE 903

Segment location on transcripts

| Transcript name | Segment starting position | Segment ending position |
|---|---|---|
| T11628_PEA_1_T3 (SEQ ID NO:103) | 912 | 967 |
| T11628_PEA_1_T4 (SEQ ID NO:104) | 897 | 952 |
| T11628_PEA_1_T5 (SEQ ID NO:105) | 879 | 934 |
| T11628_PEA_1_T7 (SEQ ID NO:106) | 864 | 919 |
| T11628_PEA_1_T9 (SEQ ID NO:107) | 738 | 793 |
| T11628_PEA_1_T11 (SEQ ID NO:108) | 954 | 1009 |

Segment cluster T11628_PEA_1_node_36 (SEQ ID NO:813) according to the present invention is supported by 122 libraries. The number of libraries was determined as previously described. This segment can be found in the following transcript(s): T11628_PEA_1_T3 (SEQ ID NO:103), T11628_PEA_1_T4 (SEQ ID NO:104), T11628_PEA_1_T5 (SEQ ID NO:105), T11628_PEA_1_T7 (SEQ ID NO:106), T11628_PEA_1_T9 (SEQ ID NO:107) and T11628_PEA_1_T11 (SEQ ID NO:108). Table 904 below describes the starting and ending position of this segment on each transcript.

TABLE 904

Segment location on transcripts

| Transcript name | Segment starting position | Segment ending position |
|---|---|---|
| T11628_PEA_1_T3 (SEQ ID NO:103) | 968 | 1085 |
| T11628_PEA_1_T4 (SEQ ID NO:104) | 953 | 1070 |

TABLE 904-continued

Segment location on transcripts

| Transcript name | Segment starting position | Segment ending position |
|---|---|---|
| T11628_PEA_1_T5 (SEQ ID NO:105) | 935 | 1052 |
| T11628_PEA_1_T7 (SEQ ID NO:106) | 920 | 1037 |
| T11628_PEA_1_T9 (SEQ ID NO:107) | 794 | 911 |
| T11628_PEA_1_T11 (SEQ ID NO:108) | 1010 | 1127 |

Variant protein alignment to the previously known protein:

Sequence name: ☐8WVH6 (SEQ ID NO:1450)

Sequence documentation:

Alignment of: T11628_PEA_1_P2 (SEQ ID NO:1376) x Q8WVH6 (SEQ ID NO:1450)

Alignment segment 1/1:

| Quality: | 962.00 | Escore: | 0 |
|---|---|---|---|
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 56 MKASEDLKKHGATVLTALGGILKKKGHHEAEIKPLAQSHATKHKIPVKYL 105
    |||||||||||||||||||||||||||||||||||||||||||||||||
  1 MKASEDLKKHGATVLTALGGILKKKGHHEAEIKPLAQSHATKHKIPVKYL  50

106 EFISECIIQVLQSKHPGDFGADAQGAMNKALELFRKDMASNYKELGFQG 154
    ||||||||||||||||||||||||||||||||||||||||||||||||
 51 EFISECIIQVLQSKHPGDFGADAQGAMNKALELFRKDMASNYKELGFQG  99
```

Sequence name: MYG_HUMAN_V1 (SEQ ID NO:1449)

Sequence documentation:

Alignment of: T11628_PEA_1_P5 (SEQ ID NO:1377) x MYG_HUMAN_V1 (SEQ ID NO:1449) . . .

Alignment segment 1/1:

| Quality: | 962.00 | Escore: | 0 |
|---|---|---|---|
| Matching length: | 99 | Total length: | 99 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKASEDLKKHGATVLTALGGILKKKGHHEAEIKPLAQSHATKHKIPVKYL  50
    |||||||||||||||||||||||||||||||||||||||||||||||||
 56 MKASEDLKKHGATVLTALGGILKKKGHHEAEIKPLAQSHATKHKIPVKYL 105

51 EFISECIIQVLQSKHPGDFGADAQGAMNKALELFRKDMASNYKELGFQG  99
    ||||||||||||||||||||||||||||||||||||||||||||||||
106 EFISECIIQVLQSKHPGDFGADAQGAMNKALELFRKDMASNYKELGFQG 154
```

Sequence name: MYG_HUMAN_V1 (SEQ ID NO:1449)

Sequence documentation:

Alignment of: T11628_PEA_1_P7 (SEQ ID NO:1378) x MYG_HUMAN_V1 (SEQ ID NO:1449) . . .

Alignment segment 1/1:

| Quality: | 1315.00 | Escore: | 0 |
|---|---|---|---|
| Matching length: | 134 | Total length: | 134 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MGLSDGEWQLVLNVWGKVEADIPGHGQEVLIRLFKGHPETLEKFDKFKHL  50
    ||||||||||||||||||||||||||||||||||||||||||||||||||
  1 MGLSDGEWQLVLNVWGKVEADIPGHGQEVLIRLFKGHPETLEKFDKFKHL  50

51 KSEDEMKASEDLKKHGATVLTALGGILKKKGHHEAEIKPLAQSHATKHKI 100
    |||||||||||||||||||||||||||||||||||||||||||||||||
 51 KSEDEMKASEDLKKHGATVLTALGGILKKKGHHEAEIKPLAQSHATKHKI 100

101 PVKYLEFISECIIQVLQSKHPGDFGADAQGAMNK                134
    |||||||||||||||||||||||||||||||||
101 PVKYLEFISECIIQVLQSKHPGDFGADAQGAMNK                134
```

Sequence name: Q8WVH6 (SEQ ID NO:1450)

Sequence documentation:

Alignment of: T11628_PEA_1_P10 (SEQ ID NO:1379) x Q8WVH6 (SEQ ID NO:1450)

Alignment segment 1/1:

| | | | |
|---|---|---|---|
| Quality: | 962.00 | Escore: | 0 |
| Matching length: | 99 | Total length: 99 | |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
 56 MKASEDLKKHGATVLTALGGILKKKGHHEAEIKPLAQSHATKHKIPVKYL 105
    |||||||||||||||||||||||||||||||||||||||||||||||||
  1 MKASEDLKKHGATVLTALGGILKKKGHHEAEIKPLAQSHATKHKIPVKYL  50

106 EFISECIIQVLQSKHPGDFGADAQGAMNKALELFRKDMASNYKELGFQG  154
    ||||||||||||||||||||||||||||||||||||||||||||||||
 51 EFISECIIQVLQSKHPGDFGADAQGAMNKALELFRKDMASNYKELGFQG   99
```

Description for Cluster HUMCEA

Cluster HUMCEA features 5 transcript(s) and 42 segment(s) of interest, the names for which are given in Tables 905 and 906, respectively, the sequences themselves are given at the end of the application. The selected protein variants are given in table 907.

TABLE 905

Transcripts of interest

| Transcript Name | Sequence ID No. |
|---|---|
| HUMCEA_PEA_1_T8 | 109 |
| HUMCEA_PEA_1_T9 | 110 |
| HUMCEA_PEA_1_T20 | 111 |
| HUMCEA_PEA_1_T25 | 112 |
| HUMCEA_PEA_1_T26 | 113 |

TABLE 906

Segments of interest

| Segment Name | Sequence ID No. |
|---|---|
| HUMCEA_PEA_1_node_0 | 814 |
| HUMCEA_PEA_1_node_2 | 815 |
| HUMCEA_PEA_1_node_11 | 816 |
| HUMCEA_PEA_1_node_12 | 817 |
| HUMCEA_PEA_1_node_31 | 818 |
| HUMCEA_PEA_1_node_36 | 819 |
| HUMCEA_PEA_1_node_44 | 820 |
| HUMCEA_PEA_1_node_46 | 821 |
| HUMCEA_PEA_1_node_63 | 822 |
| HUMCEA_PEA_1_node_65 | 823 |
| HUMCEA_PEA_1_node_67 | 824 |
| HUMCEA_PEA_1_node_3 | 825 |

TABLE 906-continued

Segments of interest

| Segment Name | Sequence ID No. |
|---|---|
| HUMCEA_PEA_1_node_7 | 826 |
| HUMCEA_PEA_1_node_8 | 827 |
| HUMCEA_PEA_1_node_9 | 828 |
| HUMCEA_PEA_1_node_10 | 829 |
| HUMCEA_PEA_1_node_15 | 830 |
| HUMCEA_PEA_1_node_16 | 831 |
| HUMCEA_PEA_1_node_17 | 832 |
| HUMCEA_PEA_1_node_18 | 833 |
| HUMCEA_PEA_1_node_19 | 834 |
| HUMCEA_PEA_1_node_20 | 835 |
| HUMCEA_PEA_1_node_21 | 836 |
| HUMCEA_PEA_1_node_22 | 837 |
| HUMCEA_PEA_1_node_23 | 838 |
| HUMCEA_PEA_1_node_24 | 839 |
| HUMCEA_PEA_1_node_27 | 840 |
| HUMCEA_PEA_1_node_29 | 841 |
| HUMCEA_PEA_1_node_30 | 842 |
| HUMCEA_PEA_1_node_33 | 843 |
| HUMCEA_PEA_1_node_34 | 844 |
| HUMCEA_PEA_1_node_35 | 845 |
| HUMCEA_PEA_1_node_45 | 846 |
| HUMCEA_PEA_1_node_50 | 847 |

TABLE 906-continued

Segments of interest

| Segment Name | Sequence ID No. |
| --- | --- |
| HUMCEA_PEA_1_node_51 | 848 |
| HUMCEA_PEA_1_node_56 | 849 |
| HUMCEA_PEA_1_node_57 | 850 |
| HUMCEA_PEA_1_node_58 | 851 |
| HUMCEA_PEA_1_node_60 | 852 |
| HUMCEA_PEA_1_node_61 | 853 |
| HUMCEA_PEA_1_node_62 | 854 |
| HUMCEA_PEA_1_node_64 | 855 |

TABLE 907

Proteins of interest

| Protein Name | Sequene ID No. | Corresponding Transcript(s) |
| --- | --- | --- |
| HUMCEA_PEA_1_P4 | 1380 | HUMCEA_PEA_1_T8 (SEQ ID NO:109) |
| HUMCEA_PEA_1_P5 | 1381 | HUMCEA_PEA_1_T9 (SEQ ID NO:110) |
| HUMCEA_PEA_1_P14 | 1382 | HUMCEA_PEA_1_T20 (SEQ ID NO:111) |
| HUMCEA_PEA_1_P19 | 1383 | HUMCEA_PEA_1_T25 (SEQ ID NO:112) |
| HUMCEA_PEA_1_P20 | 1384 | HUMCEA_PEA_1_T26 (SEQ ID NO:113) |

These sequences are variants of the known protein Carcinoembryonic antigen-related cell adhesion molecule 5 precursor (SwissProt accession identifier CEA5_HUMAN; known also according to the synonyms Carcinoembryonic antigen; CEA; Meconium antigen 100; CD66e antigen), SEQ ID NO:1451, referred to herein as the previously known protein.

The sequence for protein Carcinoembryonic antigen-related cell adhesion molecule 5 precursor (SEQ ID NO:1451) is given at the end of the application, as "Carcinoembryonic antigen-related cell adhesion molecule 5 precursor amino acid sequence". Known polymorphisms for this sequence are as shown in Table 908

TABLE 908

Amino acid mutations for Known Protein

| SNP position(s) on amine acid sequence | Comment |
| --- | --- |
| 320 | Missing |

Protein Carcinoembryonic antigen-related cell adhesion molecule 5 precursor (SEQ ID NO:1451) localization is believed to be attached to the membrane by a GPI-anchor.

The previously known protein also has the following indication(s) and/or potential therapeutic use(s): Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Imaging agent; Anticancer; Immunostimulant; Immunoconjugate; Monoclonal antibody, murine; Antisense therapy; antibody.

The following GO Annotation(s) apply to the previously known protein. The following annotation(s) were found: integral plasma membrane protein; membrane, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HUMCEA can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 33 refer to weighted expression of ESTs in each category, as "parts per million" (ratio of the expression of ESTs for a particular cluster to the expression of all ESTs in that category, according to parts per million).

Figure 33:
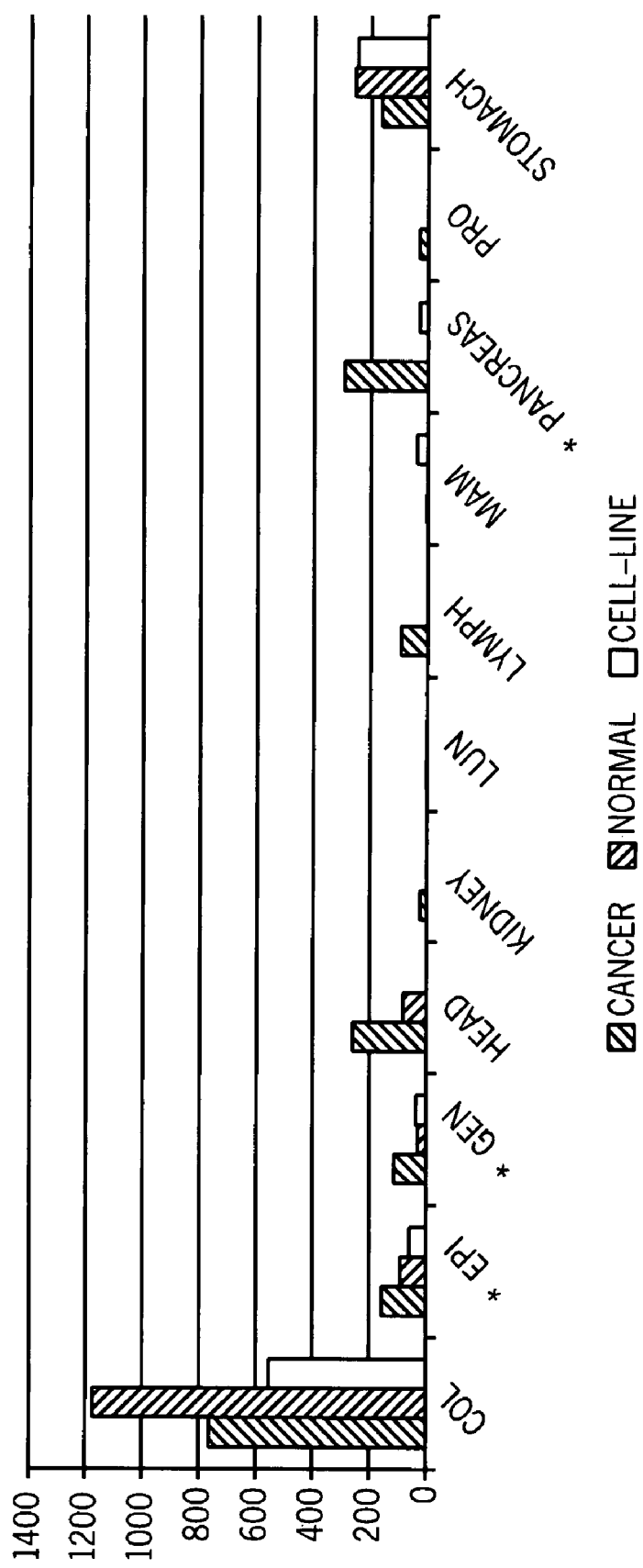
FIG. 33 is a histogram showing Cancer and cell-line vs. normal tissue expression for Cluster HUMCEA, demonstrating overexpression in epithelial malignant tumors, a mixture of malignant tumors from different tissues and pancreas carcinoma.

Overall, the following results were obtained as shown with regard to the histograms in FIG. 33 and Table 909. This cluster is overexpressed (at least at a minimum level) in the following pathological conditions: epithelial malignant tumors, a mixture of malignant tumors from different tissues and pancreas carcinoma.

TABLE 909

Normal tissue distribution

| Name of Tissue | Number |
| --- | --- |
| colon | 1175 |
| epithelial | 92 |
| general | 29 |
| head and neck | 81 |
| kidney | 0 |
| lung | 0 |
| lymph nodes | 0 |
| breast | 0 |
| pancreas | 0 |
| prostate | 0 |
| stomach | 256 |

TABLE 910

P values and ratios for expression in cancerous tissue

| Name of Tissue | P1 | P2 | SP1 | R3 | SP2 | R4 |
| --- | --- | --- | --- | --- | --- | --- |
| colon | 2.0e−01 | 2.7e−01 | 9.8e−01 | 0.5 | 1 | 0.5 |
| epithelial | 2.1e−03 | 2.7e−02 | 6.4e−04 | 1.4 | 2.1e−01 | 1.0 |
| general | 3.9e−08 | 8.2e−06 | 9.2e−18 | 3.2 | 1.3e−10 | 2.2 |
| head and neck | 3.4e−01 | 5.0e−01 | 2.1e−01 | 1.8 | 5.6e−01 | 0.9 |

TABLE 910-continued

P values and ratios for expression in cancerous tissue

| Name of Tissue | P1 | P2 | SP1 | R3 | SP2 | R4 |
|---|---|---|---|---|---|---|
| kidney | 4.3e−01 | 5.3e−01 | 5.8e−01 | 2.1 | 7.0e−01 | 1.6 |
| lung | 1.3e−01 | 2.6e−01 | 1 | 1.1 | 1 | 1.1 |
| lymph nodes | 3.1e−01 | 5.7e−01 | 8.1e−02 | 6.0 | 3.3e−01 | 2.5 |
| breast | 3.8e−01 | 1.5e−01 | 1 | 1.0 | 6.8e−01 | 1.5 |
| pancreas | 2.2e−02 | 2.3e−02 | 1.4e−08 | 7.8 | 7.4e−07 | 6.4 |
| prostate | 5.3e−02 | 6.0e−01 | 3.0e−01 | 2.5 | 4.2e−01 | 2.0 |
| stomach | 1.5e−01 | 4.7e−01 | 8.9e−01 | 0.6 | 7.2e−01 | 0.4 |

For this cluster, at least one oligonucleotide was found to demonstrate overexpression of the cluster, although not of at least one transcript/segment as listed below. Microarray (chip) data is also available for this cluster as follows. Various oligonucleotides were tested for being differentially expressed in various disease conditions, particularly cancer, as previously described. The following oligonucleotides were found to hit this cluster but not other segments/transcripts below (in relation to lung cancer), shown in Table 911.

TABLE 911

Oligonucleotides related to this cluster

| Oligonucleotides name | Overexpressed in cancers | Chip reference |
|---|---|---|
| HUMCEA_0_015168 (SEQ ID NO: 243) | lung malignant tumors | LUN |

As noted above, cluster HUMCEA features 5 transcript(s), which were listed in Table 905 above. These transcript(s) encode for protein(s) which are variant(s) of protein Carcinoembryonic antigen-related cell adhesion molecule 5 precursor (SEQ ID NO:1451). A description of each variant protein according to the present invention is now provided.

Variant protein HUMCEA_PEA_1_P4 (SEQ ID NO:1380) according to the present invention has an amino acid sequence as given at the end of the application; it is encoded by transcript(s) HUMCEA_PEA_1_T8 (SEQ ID NO:109). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P4 (SEQ ID NO:1380) and CEA5_HUMAN (SEQ ID NO:1451):

1. An isolated chimeric polypeptide encoding for HUMCEA_PEA_1_P4 (SEQ ID NO:1380), comprising a first amino acid sequence being at least 90% homologous to MESPSAPPHRWCIPWQRLLLTASLLTFWNPPTTAKL-TIESTPFNVAEGKEVLLLVHNLPQHLFGYSWYKGE RVDGNRQIIGYVIGTQQATPGPAYSGREIIYPNASL-LIQNIIQNDTGFYTLHVIKSDLVNEEATGQFRVYPEL PKPSISSNNSKPVEDKDAVAFTCEPETQ-DATYLWWVNNQSLPVSPRLQLSNGN-RTLTLFNVTRNDTASYK CETQNPVSARRSDSVILNVL corresponding to amino acids 1-234 of CEA5_HUMAN (SEQ ID NO:1451), which also corresponds to amino acids 1-234 of HUMCEA_PEA_1_P4 (SEQ ID NO:1380), and a second amino acid sequence being at least 70%, optionally at least 80%, preferably at least 85%, more preferably at least 90% and most preferably at least 95% homologous to a polypeptide having the sequence CEYICSSLAQAASPN-PQGQRQDFSVPLRFKYTDPQPWTSRLS-VTFCPRKTWADQVLTKNRRGGAASVLGG SGST-PYDGRNR (SEQ ID NO:1749) corresponding to amino acids 235-315 of HUMCEA_PEA_1_P4 (SEQ ID NO:1380), wherein said first amino acid sequence and second amino acid sequence are contiguous and in a sequential order.

2. An isolated polypeptide encoding for a tail of HUMCEA_PEA_1_P4 (SEQ ID NO:1380), comprising a polypeptide being at least 70%, optionally at least about 80%, preferably at least about 85%, more preferably at least about 90% and most preferably at least about 95% homologous to the sequence CEYICSSLAQAASPNPQGQRQDFSVPLR-FKYTDPQPWTSRLSVTFCPRKTWADQV-LTKNRRGGAASVLGG SGSTPYDGRNR (SEQ ID NO:1749) in HUMCEA_PEA_1_P4 (SEQ ID NO:1380).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P4 (SEQ ID NO:1380) also has the following non-silent SNPs (Single Nucleotide Polymorphisms) as listed in Table 912, (given according to their position(s) on the amino acid sequence, with the alternative amino acid(s) listed; the last column indicates whether the SNP is known or not; the presence of known SNPs in variant protein HUMCEA_PEA_1_P4 (SEQ ID NO:1380) sequence provides support for the deduced sequence of this variant protein according to the present invention).

TABLE 912

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |

The glycosylation sites of variant protein HUMCEA_PEA_1_P4 (SEQ ID NO:1380), as compared to the known protein Carcinoembryonic antigen-related cell adhesion molecule 5 precursor (SEQ ID NO:1451), are described in Table 913 (given according to their position(s) on the amino acid sequence in the first column; the second column indicates whether the glycosylation site is present in the variant protein; and the last column indicates whether the position is different on the variant protein).

TABLE 913

Glycosylation site(s)

| Position(s) on known amino acid sequence | Present in variant protein? | Position in variant protein? |
|---|---|---|
| 197 | yes | 197 |
| 466 | no | |

TABLE 913-continued

Glycosylation site(s)

| Position(s) on known amino acid sequence | Present in variant protein? | Position in variant protein? |
|---|---|---|
| 360 | no | |
| 288 | no | |
| 665 | no | |
| 560 | no | |
| 650 | no | |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |
| 612 | no | |
| 256 | no | |
| 508 | no | |
| 330 | no | |
| 274 | no | |
| 292 | no | |
| 553 | no | |
| 529 | no | |
| 375 | no | |

Variant protein HUMCEA_PEA_1_P4 (SEQ ID NO:1380) is encoded by the following transcript(s): HUMCEA_PEA_1_T8 (SEQ ID NO:109), for which the sequence(s) is/are given at the end of the application. The coding portion of transcript HUMCEA_PEA_1_T8 (SEQ ID NO:109) is shown in bold; this coding portion starts at position 115 and ends at position 1059. The transcript also has the following SNPs as listed in Table 914 (given according to their position on the nucleotide sequence, with the alternative nucleic acid listed; the last column indicates whether the SNP is known or not; the presence of known SNPs in variant protein HUMCEA_PEA_1_P4 (SEQ ID NO:1380) sequence provides support for the deduced sequence of this variant protein according to the present invention).

TABLE 914

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 631 | G -> A | No |
| 1315 | A -> G | No |
| 1380 | T -> C | No |
| 1533 | C -> A | Yes |
| 1706 | G -> A | Yes |
| 2308 | T -> C | No |
| 2362 | C -> T | No |
| 2455 | A -> | No |
| 2504 | C -> A | Yes |
| 2558 | G -> | No |
| 2623 | G -> | No |
| 2639 | T -> A | No |
| 2640 | T -> A | No |
| 2832 | G -> A | Yes |
| 2885 | C -> T | No |
| 3396 | A -> G | Yes |
| 3562 | C -> T | Yes |
| 3753 | G -> T | Yes |

Variant protein HUMCEA_PEA_1_P5 (SEQ ID NO:1381) according to the present invention has an amino acid sequence as given at the end of the application; it is encoded by transcript(s) HUMCEA_PEA_1_T9 (SEQ ID NO:110). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P5 (SEQ ID NO:1381) and CEA5_HUMAN (SEQ ID NO:1451):

1. An isolated chimeric polypeptide encoding for HUMCEA_PEA_1_P5 (SEQ ID NO:1381), comprising a first amino acid sequence being at least 90% homologous to MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVS corresponding to amino acids 1-675 of CEA5_HUMAN (SEQ ID NO:1451), which also corresponds to amino acids 1-675 of HUMCEA_PEA_1_P5 (SEQ ID NO:1381), and a second amino acid sequence being at least 70%, optionally at least 80%, preferably at least 85%, more preferably at least 90% and most preferably at least 95% homologous to a polypeptide having the sequence GKWLPGASASYSGVESIWFSPKSQEDIFFPSLCSMGTRKSQILS (SEQ ID NO: 1750) corresponding to amino acids 676-719 of HUMCEA_PEA_1_P5 (SEQ ID NO:1381), wherein said first amino acid sequence and second amino acid sequence are contiguous and in a sequential order.

2. An isolated polypeptide encoding for a tail of HUMCEA_PEA_1_P5 (SEQ ID NO:1381), comprising a polypeptide being at least 70%, optionally at least about 80%, preferably at least about 85%, more preferably at least about 90% and most preferably at least about 95% homologous to the sequence GKWLPGASASYSGVESIWFSPKSQEDIF-FPSLCSMGTRKSQILS (SEQ ID NO:1750) in HUM-CEA_PEA_1_P5 (SEQ ID NO:1381).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P5 (SEQ ID NO:1381) also has the following non-silent SNPs (Single Nucleotide Polymorphisms) as listed in Table 915, (given according to their position(s) on the amino acid sequence, with the alternative amino acid(s) listed; the last column indicates whether the SNP is known or not; the presence of known SNPs in variant protein HUMCEA_PEA_1_P5 (SEQ ID NO:1381) sequence provides support for the deduced sequence of this variant protein according to the present invention).

TABLE 915

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 289 | I -> T | No |
| 340 | A -> D | Yes |
| 398 | E -> K | Yes |
| 647 | P -> | No |
| 664 | R -> S | Yes |

The glycosylation sites of variant protein HUMCEA_PEA_1_P5 (SEQ ID NO:1381), as compared to the known protein Carcinoembryonic antigen-related cell adhesion molecule 5 precursor (SEQ ID NO:1451), are described in Table 916 (given according to their position(s) on the amino acid sequence in the first column; the second column indicates whether the glycosylation site is present in the variant protein; and the last column indicates whether the position is different on the variant protein).

TABLE 916

Glycosylation site(s)

| Position(s) on known amino acid sequence | Present in variant protein? | Position in variant protein? |
|---|---|---|
| 197 | yes | 197 |
| 466 | yes | 466 |
| 360 | yes | 360 |
| 288 | yes | 288 |
| 665 | yes | 665 |
| 560 | yes | 560 |
| 650 | yes | 650 |
| 480 | yes | 480 |
| 104 | yes | 104 |
| 580 | yes | 580 |
| 204 | yes | 204 |
| 115 | yes | 115 |

TABLE 916-continued

Glycosylation site(s)

| Position(s) on known amino acid sequence | Present in variant protein? | Position in variant protein? |
|---|---|---|
| 208 | yes | 208 |
| 152 | yes | 152 |
| 309 | yes | 309 |
| 432 | yes | 432 |
| 351 | yes | 351 |
| 246 | yes | 246 |
| 182 | yes | 182 |
| 612 | yes | 612 |
| 256 | yes | 256 |
| 508 | yes | 508 |
| 330 | yes | 330 |
| 274 | yes | 274 |
| 292 | yes | 292 |
| 553 | yes | 553 |
| 529 | yes | 529 |
| 375 | yes | 375 |

Variant protein HUMCEA_PEA_1_P5 (SEQ ID NO:1381) is encoded by the following transcript(s): HUMCEA_PEA_1_T9 (SEQ ID NO:110), for which the sequence(s) is/are given at the end of the application. The coding portion of transcript HUMCEA_PEA_1_T9 (SEQ ID NO:110) is shown in bold; this coding portion starts at position 115 and ends at position 2271. The transcript also has the following SNPs as listed in Table 917 (given according to their position on the nucleotide sequence, with the alternative nucleic acid listed; the last column indicates whether the SNP is known or not; the presence of known SNPs in variant protein HUMCEA_PEA_1_P5 (SEQ ID NO:1381) sequence provides support for the deduced sequence of this variant protein according to the present invention).

TABLE 917

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> G | Yes |
| 631 | G -> A | No |
| 915 | A -> G | No |
| 980 | T -> C | No |
| 1133 | C -> A | Yes |
| 1306 | G -> A | Yes |
| 1908 | T -> C | No |
| 1962 | C -> T | No |
| 2055 | A -> | No |
| 2104 | C -> A | Yes |
| 3259 | T -> C | Yes |

Variant protein HUMCEA_PEA_1_P14 (SEQ ID NO:1382) according to the present invention has an amino acid sequence as given at the end of the application; it is encoded by transcript(s) HUMCEA_PEA_1_T20 (SEQ ID NO:111). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMCEA_PEA_1_P14 (SEQ ID NO:1382) also has the following non-silent SNPs (Single Nucleotide Polymorphisms) as listed in Table 918, (given according to their position(s) on the amino acid sequence, with the alternative amino acid(s) listed; the last column indicates whether the SNP is known or not; the presence of known SNPs in variant protein HUMCEA_PEA_1_P14 (SEQ ID NO:1382) sequence provides support for the deduced sequence of this variant protein according to the present invention).

TABLE 918

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 289 | I -> T | No |
| 340 | A -> D | Yes |
| 398 | E -> K | Yes |

Variant protein HUMCEA_PEA_1_P14 (SEQ ID NO:1382) is encoded by the following transcript(s): HUMCEA_PEA_1_T20 (SEQ ID NO:111), for which the sequence(s) is/are given at the end of the application. The coding portion of transcript HUMCEA_PEA_1_T20 (SEQ ID NO:111) is shown in bold; this coding portion starts at position 115 and ends at position 1821. The transcript also has the following SNPs as listed in Table 919 (given according to their position on the nucleotide sequence, with the alternative nucleic acid listed; the last column indicates whether the SNP is known or not; the presence of known SNPs in variant protein HUMCEA_PEA_1_P14 (SEQ ID NO:1382) sequence provides support for the deduced sequence of this variant protein according to the present invention).

TABLE 919

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> G | Yes |
| 631 | G -> A | No |
| 915 | A -> G | No |
| 980 | T -> C | No |
| 1133 | C -> A | Yes |
| 1306 | G -> A | Yes |

Variant protein HUMCEA_PEA_1_P19 (SEQ ID NO:1383) according to the present invention has an amino acid sequence as given at the end of the application; it is encoded by transcript(s) HUMCEA_PEA_1_T25 (SEQ ID NO:112). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P19 (SEQ ID NO:1383) and CEA5_HUMAN (SEQ ID NO:1451):

1. An isolated chimeric polypeptide encoding for HUMCEA_PEA_1_P19 (SEQ ID NO:1383), comprising a first amino acid sequence being at least 90% homologous to MESPSAPPHRWCIPWQRLLLTASLLTFWNPPTTAKL-TIESTPFNVAEGKEVLLLVHNLPQHLFGYSWYKGE RVDGNRQIIGYVIGTQQATPGPAYSGREIIYPNASLL-IQNIIQNDTGFYTLHVIKSDLVNEEATGQFRVYPEL PKPSISSNNSKPVEDKDAVAFTCEPETQDATYLWW-VNNQSLPVSPRLQLSNGNRTLTLFNVTRNDTASYK CETQNPVSARRSDSVILN corresponding to amino acids 1-232 of CEA5_HUMAN (SEQ ID NO:1451), which also corresponds to amino acids 1-232 of HUMCEA_PEA_1_P19 (SEQ ID NO:1383), and a second amino acid sequence being at least 90% homologous to VLYGPDTPIISPPDS-SYLSGANLNLSCHSASNPSPQYSWRINGIPQQHTQ-VLFIAKITPNNNGTYACFVSNLA TGRNNSIVK-SITVSASGTSPGLSAGATVGIMIGVLVGVALI corresponding to amino acids 589-702 of CEA5_HUMAN (SEQ ID NO:1451), which also corresponds to amino acids 233-346 of HUMCEA_PEA_1_P19 (SEQ ID NO:1383), wherein said first amino acid sequence and second amino acid sequence are contiguous and in a sequential order.

2. An isolated chimeric polypeptide encoding for an edge portion of HUMCEA_PEA_1_P19 (SEQ ID NO:1383), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise NV, having a structure as follows: a sequence starting from any of amino acid numbers 232-x to 232; and ending at any of amino acid numbers 233+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P19 (SEQ ID NO:1383) also has the following non-silent SNPs (Single Nucleotide Polymorphisms) as listed in Table 920, (given according to their position(s) on the amino acid sequence, with the alternative amino acid(s) listed; the last column indicates whether the SNP is known or not; the presence of known SNPs in variant protein HUMCEA_PEA_1_P19 (SEQ ID NO:1383) sequence provides support for the deduced sequence of this variant protein according to the present invention).

TABLE 920

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 173 | D -> N | No |
| 291 | P -> | No |
| 308 | R -> S | Yes |
| 326 | G -> | No |

The glycosylation sites of variant protein HUMCEA_PEA_1_P19 (SEQ ID NO:1383), as compared to the known protein Carcinoembryonic antigen-related cell adhesion molecule 5 precursor (SEQ ID NO:1451), are described in Table 921 (given according to their position(s) on the amino acid sequence in the first column; the second column indicates whether the glycosylation site is present in the variant protein; and the last column indicates whether the position is different on the variant protein).

TABLE 921

Glycosylation site(s)

| Position(s) on known amino acid sequence | Present in variant protein? | Position in variant protein? |
|---|---|---|
| 197 | yes | 197 |
| 466 | no | |
| 360 | no | |
| 288 | no | |
| 665 | yes | 309 |
| 560 | no | |
| 650 | yes | 294 |
| 480 | no | |
| 104 | yes | 104 |
| 580 | no | |
| 204 | yes | 204 |
| 115 | yes | 115 |
| 208 | yes | 208 |
| 152 | yes | 152 |
| 309 | no | |
| 432 | no | |
| 351 | no | |
| 246 | no | |
| 182 | yes | 182 |
| 612 | yes | 256 |
| 256 | no | |
| 508 | no | |
| 330 | no | |
| 274 | no | |
| 292 | no | |
| 553 | no | |
| 529 | no | |
| 375 | no | |

Variant protein HUMCEA_PEA_1_P19 (SEQ ID NO:1383) is encoded by the following transcript(s): HUMCEA_PEA_1_T25 (SEQ ID NO:112), for which the sequence(s) is/are given at the end of the application. The coding portion of transcript HUMCEA_PEA_1_T25 (SEQ ID NO:112) is shown in bold; this coding portion starts at position 115 and ends at position 1152. The transcript also has the following SNPs as listed in Table 922 (given according to their position on the nucleotide sequence, with the alternative nucleic acid listed; the last column indicates whether the SNP is known or not; the presence of known SNPs in variant protein HUMCEA_PEA_1_P19 (SEQ ID NO:1383) sequence provides support for the deduced sequence of this variant protein according to the present invention).

TABLE 922

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> G | Yes |
| 352 | A -> G | Yes |
| 362 | T -> G | Yes |
| 524 | A -> C | Yes |
| 631 | G -> A | No |
| 840 | T -> C | No |
| 894 | C -> T | No |
| 987 | A -> | No |
| 1036 | C -> A | Yes |
| 1090 | G -> | No |
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

Variant protein HUMCEA_PEA_1_P20 (SEQ ID NO:1384) according to the present invention has an amino acid sequence as given at the end of the application; it is encoded by transcript(s) HUMCEA_PEA_1_T26 (SEQ ID NO:113). An alignment is given to the known protein (Carcinoembryonic antigen-related cell adhesion molecule 5 precursor (SEQ ID NO:1451)) at the end of the application. One or more alignments to one or more previously published protein sequences are given at the end of the application. A brief description of the relationship of the variant protein according to the present invention to each such aligned protein is as follows:

Comparison report between HUMCEA_PEA_1_P20 (SEQ ID NO:1384) and CEA5_HUMAN (SEQ ID NO:1451):

1. An isolated chimeric polypeptide encoding for HUMCEA_PEA_1_P20 (SEQ ID NO:1384), comprising a first amino acid sequence being at least 90% homologous to MESPSAPPHRWCIPWQRLLLTASLLTFWNPPTrAK-LTIESTTFNVAEGKEVLLLVHNLPQHLFGYSWYKGE RVDGNRQIIGYVIGTQQATPGPAYSGREIIYPNAS-LLIQNIIQNDTGFYTLHVIKSDLVNEEATGQFRVYP corresponding to amino acids 1-142 of CEA5_HUMAN (SEQ ID NO:1451), which also corresponds to amino acids 1-142 of HUMCEA_PEA_1_P20 (SEQ ID NO:1384), and a second amino acid sequence being at least 90% homologous to ELPKPSISSNNSKPVEDKDAVAFTCEPEAQNTTYL-WWVNGQSLPVSPRLQLSNGNRTLTLFNVTRNDARA YVCGIQNSVSANRSDPVTLDVLYGPDTPIISPPD-SSYLSGANLNLSCHSASNPSPQYSWRINGIPQQHT-QVLF IAKITPNNNGTYACFVSNLATGRNNSIVKSIT-VSASGTSPGLSAGATVGIMIGVLVGVALI corresponding to amino acids 499-702 of CEA5_HUMAN (SEQ ID NO:1451), which also corresponds to amino acids 143-346 of HUMCEA_PEA_1_P20 (SEQ ID NO:1384), wherein said first amino acid sequence and second amino acid sequence are contiguous and in a sequential order.

2. An isolated chimeric polypeptide encoding for an edge portion of HUMCEA_PEA_1_P20 (SEQ ID NO:1384), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise PE, having a structure as follows: a sequence starting from any of amino acid numbers 142-x to 142; and ending at any of amino acid numbers 143+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: membrane. The protein localization is believed to be membrane because of manual inspection of known protein localization and/or gene structure.

Variant protein HUMCEA_PEA_1_P20 (SEQ ID NO:1384) also has the following non-silent SNPs (Single Nucleotide Polymorphisms) as listed in Table 923, (given according to their position(s) on the amino acid sequence, with the alternative amino acid(s) listed; the last column indicates whether the SNP is known or not; the presence of known SNPs in variant protein HUMCEA_PEA_1_P20 (SEQ ID NO:1384) sequence provides support for the deduced sequence of this variant protein according to the present invention).

TABLE 923

Amino acid mutations

| SNP position(s) on amino acid sequence | Alternative amino acid(s) | Previously known SNP? |
|---|---|---|
| 63 | F -> L | No |
| 80 | I -> V | Yes |
| 83 | V -> A | Yes |
| 137 | Q -> P | Yes |
| 291 | P -> | No |
| 308 | R -> S | Yes |
| 326 | G -> | No |

The glycosylation sites of variant protein HUMCEA_PEA_1_P20 (SEQ ID NO:1384), as compared to the known protein Carcinoembryonic antigen-related cell adhesion molecule 5 precursor (SEQ ID NO:1451), are described in Table 924 (given according to their position(s) on the amino acid sequence in the first column; the second column indicates whether the glycosylation site is present in the variant protein; and the last column indicates whether the position is different on the variant protein).

TABLE 924

Glycosylation site(s)

| Position(s) on known amino acid sequence | Present in variant protein? | Position in variant protein? |
|---|---|---|
| 197 | no | |
| 466 | no | |
| 360 | no | |
| 288 | no | |
| 665 | yes | 309 |
| 560 | yes | 204 |
| 650 | yes | 294 |
| 480 | no | |
| 104 | yes | 104 |
| 580 | yes | 224 |
| 204 | no | |
| 115 | yes | 115 |
| 208 | no | |

TABLE 924-continued

Glycosylation site(s)

| Position(s) on known amino acid sequence | Present in variant protein? | Position in variant protein? |
|---|---|---|
| 152 | no | |
| 309 | no | |
| 432 | no | |
| 351 | no | |
| 246 | no | |
| 182 | no | |
| 612 | yes | 256 |
| 256 | no | |
| 508 | yes | 152 |
| 330 | no | |
| 274 | no | |
| 292 | no | |
| 553 | yes | 197 |
| 529 | yes | 173 |
| 375 | no | |

Variant protein HUMCEA_PEA_1_P20 (SEQ ID NO:1384) is encoded by the following transcript(s): HUMCEA_PEA_1_T26 (SEQ ID NO:113), for which the sequence(s) is/are given at the end of the application. The coding portion of transcript HUMCEA_PEA_1_T26 (SEQ ID NO:113) is shown in bold; this coding portion starts at position 115 and ends at position 1152. The transcript also has the following SNPs as listed in Table 925 (given according to their position on the nucleotide sequence, with the alternative nucleic acid listed; the last column indicates whether the SNP is known or not; the presence of known SNPs in variant protein HUMCEA_PEA_1_P20 (SEQ ID NO:1384) sequence provides support for the deduced sequence of this variant protein according to the present invention).

TABLE 925

Nucleic acid SNPs

| SNP position on nucleotide sequence | Alternative nucleic acid | Previously known SNP? |
|---|---|---|
| 49 | T -> | No |
| 273 | A -> C | Yes |
| 303 | T -> G | No |
| 324 | T -> C | Yes |
| 352 | A -> G | Yes |
| 362 | T -> C | Yes |
| 524 | A -> C | Yes |
| 840 | T -> C | No |
| 894 | C -> T | No |
| 987 | A -> | No |
| 1036 | C -> A | Yes |
| 1090 | G -> | No |
| 1155 | G -> | No |
| 1171 | T -> A | No |
| 1172 | T -> A | No |
| 1364 | G -> A | Yes |
| 1417 | C -> T | No |
| 1928 | A -> G | Yes |
| 2094 | C -> T | Yes |
| 2285 | C -> T | Yes |

As noted above, cluster HUMCEA features 42 segment(s), which were listed in Table 906 above and for which the sequence(s) are given at the end of the application. These segment(s) are portions of nucleic acid sequence(s) which are described herein separately because they are of particular interest. A description of each segment according to the present invention is now provided.

Segment cluster HUMCEA_PEA_1_node_0 (SEQ ID NO:814) according to the present invention is supported by 56 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111), HUMCEA_PEA_1_T25 (SEQ ID NO:112) and HUMCEA_PEA_1_T26 (SEQ ID NO:113). Table 926 below describes the starting and ending position of this segment on each transcript.

TABLE 926

Segment location on transcripts

| Transcript name | Segment starting position | Segment ending position |
|---|---|---|
| HUMCEA_PEA_1_T8 (SEQ ID NO:109) | 1 | 178 |
| HUMCEA_PEA_1_T9 (SEQ ID NO:110) | 1 | 178 |
| HUMCEA_PEA_1_T20 (SEQ ID NO:111) | 1 | 178 |
| HUMCEA_PEA_1_T25 (SEQ ID NO:112) | 1 | 178 |
| HUMCEA_PEA_1_T26 (SEQ ID NO:113) | 1 | 178 |

Segment cluster HUMCEA_PEA_1_node_2 (SEQ ID NO:815) according to the present invention is supported by 83 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111), HUMCEA_PEA_1_T25 (SEQ ID NO:112) and HUMCEA_PEA_1_T26 (SEQ ID NO:113). Table 927 below describes the starting and ending position of this segment on each transcript.

TABLE 927

Segment location on transcripts

| Transcript name | Segment starting position | Segment ending position |
|---|---|---|
| HUMCEA_PEA_1_T8 (SEQ ID NO:109) | 179 | 456 |
| HUMCEA_PEA_1_T9 (SEQ ID NO:110) | 179 | 456 |
| HUMCEA_PEA_1_T20 (SEQ ID NO:111) | 179 | 456 |
| HUMCEA_PEA_1_T25 (SEQ ID NO:112) | 179 | 456 |
| HUMCEA_PEA_1_T26 (SEQ ID NO:113) | 179 | 456 |

Segment cluster HUMCEA_PEA_1_node_11 (SEQ ID NO:816) according to the present invention is supported by 6 libraries. The number of libraries was determined as previously described. This segment can be found in the following transcript(s): HUMCEA_PEA_1_T8 (SEQ ID NO:109). Table 928 below describes the starting and ending position of this segment on each transcript.

TABLE 928

Segment location on transcripts

| Transcript name | Segment starting position | Segment ending position |
|---|---|---|
| HUMCEA_PEA_1_T8 (SEQ ID NO:109) | 818 | 1217 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 929.

TABLE 929

Oligonucleotides related to this segment

| Oligonucleotide name | Overexpressed in cancers | Chip reference |
|---|---|---|
| HUMCEA_0_0_96 (SEQ ID NO:240) | lung malignant tumors | LUN |

Segment cluster HUMCEA_PEA_1_node_12 (SEQ ID NO:817) according to the present invention is supported by 83 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 930 below describes the starting and ending position of this segment on each transcript.

TABLE 930

Segment location on transcripts

| Transcript name | Segment starting position | Segment ending position |
|---|---|---|
| HUMCEA_PEA_1_T8 (SEQ ID NO:109) | 1218 | 1472 |
| HUMCEA_PEA_1_T9 (SEQ ID NO:110) | 818 | 1072 |
| HUMCEA_PEA_1_T20 (SEQ ID NO:111) | 818 | 1072 |

Segment cluster HUMCEA_PEA_1_node_31 (SEQ ID NO:818) according to the present invention is supported by 87 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 931 below describes the starting and ending position of this segment on each transcript.

TABLE 931

Segment location on transcripts

| Transcript name | Segment starting position | Segment ending position |
|---|---|---|
| HUMCEA_PEA_1_T8 (SEQ ID NO:109) | 1817 | 2006 |
| HUMCEA_PEA_1_T9 (SEQ ID NO:110) | 1417 | 1606 |
| HUMCEA_PEA_1_T20 (SEQ ID NO:111) | 1417 | 1606 |

Segment cluster HUMCEA_PEA_1_node_36 (SEQ ID NO:819) according to the present invention is supported by 94 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 932 below describes the starting and ending position of this segment on each transcript.

TABLE 932

Segment location on transcripts

| Transcript name | Segment starting position | Segment ending position |
|---|---|---|
| HUMCEA_PEA_1_T8 (SEQ ID NO:109) | 2159 | 2285 |
| HUMCEA_PEA_1_T9 (SEQ ID NO:110) | 1759 | 1885 |
| HUMCEA_PEA_1_T26 (SEQ ID NO:113) | 691 | 817 |

Segment cluster HUMCEA_PEA_1_node_44 (SEQ ID NO:820) according to the present invention is supported by 112 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T25 (SEQ ID NO:112) and HUMCEA_PEA_1_T26 (SEQ ID NO:113). Table 933 below describes the starting and ending position of this segment on each transcript.

TABLE 933

Segment location on transcripts

| Transcript name | Segment starting position | Segment ending position |
|---|---|---|
| HUMCEA_PEA_1_T8 (SEQ ID NO:109) | 2286 | 2540 |
| HUMCEA_PEA_1_T9 (SEQ ID NO:110) | 1886 | 2140 |
| HUMCEA_PEA_1_T25 (SEQ ID NO:112) | 818 | 1072 |
| HUMCEA_PEA_1_T26 (SEQ ID NO:113) | 818 | 1072 |

Segment cluster HUMCEA_PEA_1_node_46 (SEQ ID NO:821) according to the present invention is supported by 15 libraries. The number of libraries was determined as previously described. This segment can be found in the following transcript(s): HUMCEA_PEA_1_T9 (SEQ ID NO:110). Table 934 below describes the starting and ending position of this segment on each transcript.

TABLE 934

Segment location on transcripts

| Transcript name | Segment starting position | Segment ending position |
|---|---|---|
| HUMCEA_PEA_1_T9 (SEQ ID NO:110) | 2174 | 3347 |

Segment cluster HUMCEA_PEA_1_node_63 (SEQ ID NO:822) according to the present invention is supported by 68 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 935 below describes the starting and ending position of this segment on each transcript.

TABLE 935

Segment location on transcripts

| Transcript name | Segment starting position | Segment ending position |
|---|---|---|
| HUMCEA_PEA_1_T8 (SEQ ID NO:109) | 2957 | 3135 |
| HUMCEA_PEA_1_T25 (SEQ ID NO:112) | 1489 | 1667 |
| HUMCEA_PEA_1_T26 (SEQ ID NO:113) | 1489 | 1667 |

Segment cluster HUMCEA_PEA_1_node_65 (SEQ ID NO:823) according to the present invention is supported by 54 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 936 below describes the starting and ending position of this segment on each transcript.

TABLE 936

Segment location on transcripts

| Transcript name | Segment starting position | Segment ending position |
|---|---|---|
| HUMCEA_PEA_1_T8 (SEQ ID NO:109) | 3166 | 3897 |
| HUMCEA_PEA_1_T25 (SEQ ID NO:112) | 1698 | 2429 |
| HUMCEA_PEA_1_T26 (SEQ ID NO:113) | 1698 | 2429 |

Segment cluster HUMCEA_PEA_1_node_67 (SEQ ID NO:824) according to the present invention is supported by 2 libraries. The number of libraries was determined as previously described. This segment can be found in the following transcript(s): HUMCEA_PEA_1_T20 (SEQ ID NO:111). Table 937 below describes the starting and ending position of this segment on each transcript.

TABLE 937

Segment location on transcripts

| Transcript name | Segment starting position | Segment ending position |
|---|---|---|
| HUMCEA_PEA_1_T20 (SEQ ID NO:111) | 1607 | 1886 |

According to an optional embodiment of the present invention, short segments related to the above cluster are also provided. These segments are up to about 120 bp in length, and so are included in a separate description.

Segment cluster HUMCEA_PEA_1_node_3 (SEQ ID NO:825) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111), HUMCEA_PEA_1_T25 (SEQ ID NO:112) and HUMCEA_PEA_1_T26 (SEQ ID NO:113). Table 938 below describes the starting and ending position of this segment on each transcript.

TABLE 938

Segment location on transcripts

| Transcript name | Segment starting position | Segment ending position |
|---|---|---|
| HUMCEA_PEA_1_T8 (SEQ ID NO:109) | 457 | 538 |
| HUMCEA_PEA_1_T9 (SEQ ID NO:110) | 457 | 538 |
| HUMCEA_PEA_1_T20 (SEQ ID NO:111) | 457 | 538 |
| HUMCEA_PEA_1_T25 (SEQ ID NO:112) | 457 | 538 |
| HUMCEA_PEA_1_T26 (SEQ ID NO:113) | 457 | 538 |

Segment cluster HUMCEA_PEA_1_1_node_7 (SEQ ID NO:826) according to the present invention is supported by 73 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 939 below describes the starting and ending position of this segment on each transcript.

TABLE 939

Segment location on transcripts

| Transcript name | Segment starting position | Segment ending position |
|---|---|---|
| HUMCEA_PEA_1_T8 (SEQ ID NO:109) | 539 | 642 |
| HUMCEA_PEA_1_T9 (SEQ ID NO:110) | 539 | 642 |
| HUMCEA_PEA_1_T20 (SEQ ID NO:111) | 539 | 642 |
| HUMCEA_PEA_1_T25 (SEQ ID NO:112) | 539 | 642 |

Segment cluster HUMCEA_PEA_1_node_8 (SEQ ID NO:827) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 940 below describes the starting and ending position of this segment on each transcript.

TABLE 940

Segment location on transcripts

| Transcript name | Segment starting position | Segment ending position |
|---|---|---|
| HUMCEA_PEA_1_T8 (SEQ ID NO:109) | 643 | 690 |
| HUMCEA_PEA_1_T9 (SEQ ID NO:110) | 643 | 690 |
| HUMCEA_PEA_1_T20 (SEQ ID NO:111) | 643 | 690 |
| HUMCEA_PEA_1_T25 (SEQ ID NO:112) | 643 | 690 |

Segment cluster HUMCEA_PEA_1_node_9 (SEQ ID NO:828) according to the present invention is supported by 71 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 941 below describes the starting and ending position of this segment on each transcript.

TABLE 941

Segment location on transcripts

| Transcript name | Segment starting position | Segment ending position |
|---|---|---|
| HUMCEA_PEA_1_T8 (SEQ ID NO:109) | 691 | 738 |
| HUMCEA_PEA_1_T9 (SEQ ID NO:110) | 691 | 738 |
| HUMCEA_PEA_1_T20 (SEQ ID NO:111) | 691 | 738 |
| HUMCEA_PEA_1_T25 (SEQ ID NO:112) | 691 | 738 |

Segment cluster HUMCEA_PEA_1_node_10 (SEQ ID NO:829) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110), HUMCEA_PEA_1_T20 (SEQ ID NO:111) and HUMCEA_PEA_1_T25 (SEQ ID NO:112). Table 942 below describes the starting and ending position of this segment on each transcript.

TABLE 942

Segment location on transcripts

| Transcript name | Segment starting position | Segment ending position |
|---|---|---|
| HUMCEA_PEA_1_T8 (SEQ ID NO:109) | 739 | 817 |
| HUMCEA_PEA_1_T9 (SEQ ID NO:110) | 739 | 817 |
| HUMCEA_PEA_1_T20 (SEQ ID NO:111) | 739 | 817 |
| HUMCEA_PEA_1_T25 (SEQ ID NO:112) | 739 | 817 |

Segment cluster HUMCEA_PEA_1_node_15 (SEQ ID NO:830) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 943 below describes the starting and ending position of this segment on each transcript.

TABLE 943

Segment location on transcripts

| Transcript name | Segment starting position | Segment ending position |
|---|---|---|
| HUMCEA_PEA_1_T8 (SEQ ID NO:109) | 1473 | 1475 |
| HUMCEA_PEA_1_T9 (SEQ ID NO:110) | 1073 | 1075 |
| HUMCEA_PEA_1_T20 (SEQ ID NO:111) | 1073 | 1075 |

Segment cluster HUMCEA_PEA_1_node_16 (SEQ ID NO:831) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 944 below describes the starting and ending position of this segment on each transcript.

TABLE 944

Segment location on transcripts

| Transcript name | Segment starting position | Segment ending position |
|---|---|---|
| HUMCEA_PEA_1_T8 (SEQ ID NO:109) | 1476 | 1481 |
| HUMCEA_PEA_1_T9 (SEQ ID NO:110) | 1076 | 1081 |
| HUMCEA_PEA_1_T20 (SEQ ID NO:111) | 1076 | 1081 |

Segment cluster HUMCEA_PEA_1_node_17 (SEQ ID NO:832) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 945 below describes the starting and ending position of this segment on each transcript.

TABLE 945

Segment location on transcripts

| Transcript name | Segment starting position | Segment ending position |
|---|---|---|
| HUMCEA_PEA_1_T8 (SEQ ID NO:109) | 1482 | 1488 |
| HUMCEA_PEA_1_T9 (SEQ ID NO:110) | 1082 | 1088 |
| HUMCEA_PEA_1_T20 (SEQ ID NO:111) | 1082 | 1088 |

Segment cluster HUMCEA_PEA_1_node_18 (SEQ ID NO:833) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 946 below describes the starting and ending position of this segment on each transcript.

TABLE 946

Segment location on transcripts

| Transcript name | Segment starting position | Segment ending position |
|---|---|---|
| HUMCEA_PEA_1_T8 (SEQ ID NO:109) | 1489 | 1506 |
| HUMCEA_PEA_1_T9 (SEQ ID NO:110) | 1089 | 1106 |
| HUMCEA_PEA_1_T20 (SEQ ID NO:111) | 1089 | 1106 |

Segment cluster HUMCEA_PEA_1_node_19 (SEQ ID NO:834) according to the present invention is supported by 69 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 947 below describes the starting and ending position of this segment on each transcript.

TABLE 947

Segment location on transcripts

| Transcript name | Segment starting position | Segment ending position |
|---|---|---|
| HUMCEA_PEA_1_T8 (SEQ ID NO:109) | 1507 | 1576 |
| HUMCEA_PEA_1_T9 (SEQ ID NO:110) | 1107 | 1176 |
| HUMCEA_PEA_1_T20 (SEQ ID NO:111) | 1107 | 1176 |

Segment cluster HUMCEA_PEA_1_node_20 (SEQ ID NO:835) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 948 below describes the starting and ending position of this segment on each transcript.

TABLE 948

Segment location on transcripts

| Transcript name | Segment starting position | Segment ending position |
|---|---|---|
| HUMCEA_PEA_1_T8 (SEQ ID NO:109) | 1577 | 1600 |
| HUMCEA_PEA_1_T9 (SEQ ID NO:110) | 1177 | 1200 |
| HUMCEA_PEA_1_T20 (SEQ ID NO:111) | 1177 | 1200 |

Segment cluster HUMCEA_PEA_1_node_21 (SEQ ID NO:836) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 949 below describes the starting and ending position of this segment on each transcript.

TABLE 949

Segment location on transcripts

| Transcript name | Segment starting position | Segment ending position |
|---|---|---|
| HUMCEA_PEA_1_T8 (SEQ ID NO:109) | 1601 | 1624 |
| HUMCEA_PEA_1_T9 (SEQ ID NO:110) | 1201 | 1224 |
| HUMCEA_PEA_1_T20 (SEQ ID NO:111) | 1201 | 1224 |

Segment cluster HUMCEA_PEA_1_node_22 (SEQ ID NO:837) according to the present invention is supported by 77 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 950 below describes the starting and ending position of this segment on each transcript.

TABLE 950

| | Segment location on transcripts | |
|---|---|---|
| Transcript name | Segment starting position | Segment ending position |
| HUMCEA_PEA_1_T8 (SEQ ID NO:109) | 1625 | 1702 |
| HUMCEA_PEA_1_T9 (SEQ ID NO:110) | 1225 | 1302 |
| HUMCEA_PEA_1_T20 (SEQ ID NO:111) | 1225 | 1302 |

Segment cluster HUMCEA_PEA_1_node_23 (SEQ ID NO:838) according to the present invention is supported by 72 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 951 below describes the starting and ending position of this segment on each transcript.

TABLE 951

| | Segment location on transcripts | |
|---|---|---|
| Transcript name | Segment starting position | Segment ending position |
| HUMCEA_PEA_1_T8 (SEQ ID NO:109) | 1703 | 1732 |
| HUMCEA_PEA_1_T9 (SEQ ID NO:110) | 1303 | 1332 |
| HUMCEA_PEA_1_T20 (SEQ ID NO:111) | 1303 | 1332 |

Segment cluster HUMCEA_PEA_1_node_24 (SEQ ID NO:839) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 952 below describes the starting and ending position of this segment on each transcript.

TABLE 952

| | Segment location on transcripts | |
|---|---|---|
| Transcript name | Segment starting position | Segment ending position |
| HUMCEA_PEA_1_T8 (SEQ ID NO:109) | 1733 | 1751 |
| HUMCEA_PEA_1_T9 (SEQ ID NO:110) | 1333 | 1351 |
| HUMCEA_PEA_1_T20 (SEQ ID NO:111) | 1333 | 1351 |

Segment cluster HUMCEA_PEA_1_node_27 (SEQ ID NO:840) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 953 below describes the starting and ending position of this segment on each transcript.

TABLE 953

| | Segment location on transcripts | |
|---|---|---|
| Transcript name | Segment starting position | Segment ending position |
| HUMCEA_PEA_1_T8 (SEQ ID NO:109) | 1752 | 1770 |
| HUMCEA_PEA_1_T9 (SEQ ID NO:110) | 1352 | 1370 |
| HUMCEA_PEA_1_T20 (SEQ ID NO:111) | 1352 | 1370 |

Segment cluster HUMCEA_PEA_1_node_29 (SEQ ID NO:841) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 954 below describes the starting and ending position of this segment on each transcript.

TABLE 954

| | Segment location on transcripts | |
|---|---|---|
| Transcript name | Segment starting position | Segment ending position |
| HUMCEA_PEA_1_T8 (SEQ ID NO:109) | 1771 | 1788 |
| HUMCEA_PEA_1_T9 (SEQ ID NO:110) | 1371 | 1388 |
| HUMCEA_PEA_1_T20 (SEQ ID NO:111) | 1371 | 1388 |

Segment cluster HUMCEA_PEA_1_node_30 (SEQ ID NO:842) according to the present invention is supported by 67 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T20 (SEQ ID NO:111). Table 955 below describes the starting and ending position of this segment on each transcript.

TABLE 955

| | Segment location on transcripts | |
|---|---|---|
| Transcript name | Segment starting position | Segment ending position |
| HUMCEA_PEA_1_T8 (SEQ ID NO:109) | 1789 | 1816 |
| HUMCEA_PEA_1_T9 (SEQ ID NO:110) | 1389 | 1416 |
| HUMCEA_PEA_1_T20 (SEQ ID NO:111) | 1389 | 1416 |

Segment cluster HUMCEA_PEA_1_node_33 (SEQ ID NO:843) according to the present invention can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 956 below describes the starting and ending position of this segment on each transcript.

TABLE 956

Segment location on transcripts

| Transcript name | Segment starting position | Segment ending position |
|---|---|---|
| HUMCEA_PEA_1_T8 (SEQ ID NO:109) | 2007 | 2028 |
| HUMCEA_PEA_1_T9 (SEQ ID NO:110) | 1607 | 1628 |
| HUMCEA_PEA_1_T26 (SEQ ID NO:113) | 539 | 560 |

Segment cluster HUMCEA_PEA_1_node_34 (SEQ ID NO:844) according to the present invention is supported by 80 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 957 below describes the starting and ending position of this segment on each transcript.

TABLE 957

Segment location on transcripts

| Transcript name | Segment starting position | Segment ending position |
|---|---|---|
| HUMCEA_PEA_1_T8 (SEQ ID NO:109) | 2029 | 2110 |
| HUMCEA_PEA_1_T9 (SEQ ID NO:110) | 1629 | 1710 |
| HUMCEA_PEA_1_T26 (SEQ ID NO:113) | 561 | 642 |

Segment cluster HUMCEA_PEA_1_node_35 (SEQ ID NO:845) according to the present invention is supported by 75 libraries. The number of libraries was determined as previously described. This segment can be found in the following transcript(s): HUMCEA_PEA_1_T8 (SEQ ID NO:109), HUMCEA_PEA_1_T9 (SEQ ID NO:110) and HUMCEA_PEA_1_T26 (SEQ ID NO:113). Table 958 below describes the starting and ending position of this segment on each transcript.

TABLE 958

Segment location on transcripts

| Transcript name | Segment starting position | Segment ending position |
|---|---|---|
| HUMCEA_PEA_1_T8 (SEQ ID NO:109) | 2111 | 2158 |
| HUMCEA_PEA_1_T9 (SEQ ID NO:110) | 1711 | 1758 |
| HUMCEA_PEA_1_T26 (SEQ ID NO:113) | 643 | 690 |

Segment cluster HUMCEA_PEA_1_node_45 (SEQ ID NO:846) according to the present invention is supported by 9 libraries. The number of libraries was determined as previously described. This segment can be found in the following transcript(s): HUMCEA_PEA_1_T9 (SEQ ID NO:110). Table 959 below describes the starting and ending position of this segment on each transcript.

TABLE 959

Segment location on transcripts

| Transcript name | Segment starting position | Segment ending position |
|---|---|---|
| HUMCEA_PEA_1_T9 (SEQ ID NO:110) | 2141 | 2173 |

Segment cluster HUMCEA_PEA_1_node_50 (SEQ ID NO:847) according to the present invention is supported by 64 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 960 below describes the starting and ending position of this segment on each transcript.

TABLE 960

Segment location on transcripts

| Transcript name | Segment starting position | Segment ending position |
|---|---|---|
| HUMCEA_PEA_1_T8 (SEQ ID NO:109) | 2541 | 2567 |
| HUMCEA_PEA_1_T25 (SEQ ID NO:112) | 1073 | 1099 |
| HUMCEA_PEA_1_T26 (SEQ ID NO:113) | 1073 | 1099 |

Segment cluster HUMCEA_PEA_1_node_51 (SEQ ID NO:848) according to the present invention is supported by 88 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 961 below describes the starting and ending position of this segment on each transcript.

TABLE 961

Segment location on transcripts

| Transcript name | Segment starting position | Segment ending position |
|---|---|---|
| HUMCEA_PEA_1_T8 (SEQ ID NO:109) | 2568 | 2659 |
| HUMCEA_PEA_1_T25 (SEQ ID NO:112) | 1100 | 1191 |
| HUMCEA_PEA_1_T26 (SEQ ID NO:113) | 1100 | 1191 |

Segment cluster HUMCEA_PEA_1_node_56 (SEQ ID NO:849) according to the present invention is supported by 75 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 962 below describes the starting and ending position of this segment on each transcript.

TABLE 962

Segment location on transcripts

| Transcript name | Segment starting position | Segment ending position |
|---|---|---|
| HUMCEA_PEA_1_T8 (SEQ ID NO:109) | 2660 | 2685 |
| HUMCEA_PEA_1_T25 (SEQ ID NO:112) | 1192 | 1217 |
| HUMCEA_PEA_1_T26 (SEQ ID NO:113) | 1192 | 1217 |

Segment cluster HUMCEA_PEA_1_node_57 (SEQ ID NO:850) according to the present invention is supported by 82 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 963 below describes the starting and ending position of this segment on each transcript.

TABLE 963

Segment location on transcripts

| Transcript name | Segment starting position | Segment ending position |
|---|---|---|
| HUMCEA_PEA_1_T8 (SEQ ID NO:109) | 2686 | 2786 |
| HUMCEA_PEA_1_T25 (SEQ ID NO:112) | 1218 | 1318 |
| HUMCEA_PEA_1_T26 (SEQ ID NO:113) | 1218 | 1318 |

Segment cluster HUMCEA_PEA_1_node_58 (SEQ ID NO:851) according to the present invention is supported by 63 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 964 below describes the starting and ending position of this segment on each transcript.

TABLE 964

Segment location on transcripts

| Transcript name | Segment starting position | Segment ending position |
|---|---|---|
| HUMCEA_PEA_1_T8 (SEQ ID NO:109) | 2787 | 2820 |
| HUMCEA_PEA_1_T25 (SEQ ID NO:112) | 1319 | 1352 |
| HUMCEA_PEA_1_T26 (SEQ ID NO:113) | 1319 | 1352 |

Segment cluster HUMCEA_PEA_1_node_60 (SEQ ID NO:852) according to the present invention is supported by 55 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 965 below describes the starting and ending position of this segment on each transcript.

TABLE 965

Segment location on transcripts

| Transcript name | Segment starting position | Segment ending position |
|---|---|---|
| HUMCEA_PEA_1_T8 (SEQ ID NO:109) | 2821 | 2864 |
| HUMCEA_PEA_1_T25 (SEQ ID NO:112) | 1353 | 1396 |
| HUMCEA_PEA_1_T26 (SEQ ID NO:113) | 1353 | 1396 |

Segment cluster HUMCEA_PEA_1_node_61 (SEQ ID NO:853) according to the present invention can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 966 below describes the starting and ending position of this segment on each transcript.

TABLE 966

Segment location on transcripts

| Transcript name | Segment starting position | Segment ending position |
|---|---|---|
| HUMCEA_PEA_1_T8 (SEQ ID NO:109) | 2865 | 2868 |
| HUMCEA_PEA_1_T25 (SEQ ID NO:112) | 1397 | 1400 |
| HUMCEA_PEA_1_T26 (SEQ ID NO:113) | 1397 | 1400 |

Segment cluster HUMCEA_PEA_1_node_62 (SEQ ID NO:854) according to the present invention is supported by 60 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 967 below describes the starting and ending position of this segment on each transcript.

TABLE 967

Segment location on transcripts

| Transcript name | Segment starting position | Segment ending position |
|---|---|---|
| HUMCEA_PEA_1_T8 (SEQ ID NO:109) | 2869 | 2956 |
| HUMCEA_PEA_1_T25 (SEQ ID NO:112) | 1401 | 1488 |
| HUMCEA_PEA_1_T26 (SEQ ID NO:113) | 1401 | 1488 |

Segment cluster HUMCEA_PEA_1_node_64 (SEQ ID NO:855) according to the present invention is supported by 45 libraries. The number of libraries was determined as previously described. This segment can be found in the following transcript(s): HUMCEA_PEA_1_T8 (SEQ ID NO:109), HUMCEA_PEA_1_T25 (SEQ ID NO:112) and HUMCEA_PEA_1_T26 (SEQ ID NO:113). Table 968 below describes the starting and ending position of this segment on each transcript.

TABLE 968

Segment location on transcripts

| Transcript name | Segment starting position | Segment ending position |
|---|---|---|
| HUMCEA_PEA_1_T8 (SEQ ID NO:109) | 3136 | 3165 |
| HUMCEA_PEA_1_T25 (SEQ ID NO:112) | 1668 | 1697 |
| HUMCEA_PEA_1_T26 (SEQ ID NO:113) | 1668 | 1697 |

Variant protein alignment to the previously known protein:

Sequence name: CEA5_HUMAN (SEQ ID NO:1451)

Sequence documentation:

Alignment of: HUMCEA_PEA_1_P4 (SEQ ID NO:1380) x CEA5_HUMAN (SEQ ID NO:1451)

Alignment segment 1/1:

| | | | |
|---|---|---|---|
| Quality: | 2320.00 | Escore: | 0 |
| Matching length: | 234 | Total length: | 234 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILNVL               234
    |||||||||||||||||||||||||||||||||
201 TLFNVTRNDTASYKCETQNPVSARRSDSVILNVL               234
```

Sequence name: CEA5_HUMAN (SEQ ID NO:1451)

Sequence documentation:

Alignment of: HUMCEA_PEA_1_P5 (SEQ ID NO:1381) x CEA5_HUMAN (SEQ ID NO:1451)

Alignment segment 1/1:

| | | | |
|---|---|---|---|
| Quality: | 6692.00 | Escore: | 0 |
| Matching length: | 675 | Total length: | 675 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200
```

-continued

```
201 TLFNVTRNDTASYKCETQNPVSARRSDSVILNVLYGPDAPTISPLNTSYR 250
    ||||||||||||||||||||||||||||||||||||||||||||||||||
201 TLFNVTRNDTASYKCETQNPVSARRSDSVILNVLYGPDAPTISPLNTSYR 250

251 SGENLNLSCHAASNPPAQYSWFVNGTFQQSTQELFIPNITVNNSGSYTCQ 300
    ||||||||||||||||||||||||||||||||||||||||||||||||||
251 SGENLNLSCHAASNPPAQYSWFVNGTFQQSTQELFIPNITVNNSGSYTCQ 300

301 AHNSDTGLNRTTVTTITVYAEPPKPFITSNNSNPVEDEDAVALTCEPEIQ 350
    ||||||||||||||||||||||||||||||||||||||||||||||||||
301 AHNSDTGLNRTTVTTITVYAEPPKPFITSNNSNPVEDEDAVALTCEPEIQ 350

351 NTTYLWWVNNQSLPVSPRLQLSNDNRTLTLLSVTRNDVGPYECGIQNELS 400
    ||||||||||||||||||||||||||||||||||||||||||||||||||
351 NTTYLWWVNNQSLPVSPRLQLSNDNRTLTLLSVTRNDVGPYECGIQNELS 400

401 VDHSDPVILNVLYGPDDPTISPSYTYYRPGVNLSLSCHAASNPPAQYSWL 450
    ||||||||||||||||||||||||||||||||||||||||||||||||||
401 VDHSDPVILNVLYGPDDPTISPSYTYYRPGVNLSLSCHAASNPPAQYSWL 450

451 IDGNIQQHTQELFISNITEKNSGLYTCQANNSASGHSRTTVKTITVSAEL 500
    ||||||||||||||||||||||||||||||||||||||||||||||||||
451 IDGNIQQHTQELFISNITEKNSGLYTCQANNSASGHSRTTVKTITVSAEL 500

501 PKPSISSNNSKPVEDKDAVAFTCEPEAQNTTYLWWVNGQSLPVSPRLQLS 550
    ||||||||||||||||||||||||||||||||||||||||||||||||||
501 PKPSISSNNSKPVEDKDAVAFTCEPEAQNTTYLWWVNGQSLPVSPRLQLS 550

551 NGNRTLTLFNVTRNDARAYVCGIQNSVSANRSDPVTLDVLYGPDTPIISP 600
    ||||||||||||||||||||||||||||||||||||||||||||||||||
551 NGNRTLTLFNVTRNDARAYVCGIQNSVSANRSDPVTLDVLYGPDTPIISP 600

601 PDSSYLSGANLNLSCHSASNPSPQYSWRINGIPQQHTQVLFIAKITPNNN 650
    ||||||||||||||||||||||||||||||||||||||||||||||||||
601 PDSSYLSGANLNLSCHSASNPSPQYSWRINGIPQQHTQVLFIAKITPNNN 650

651 GTYACFVSNLATGRNNSIVKSITVS                         675
    |||||||||||||||||||||||||
651 GTYACFVSNLATGRNNSIVKSITVS                         675
```

Sequence name: CEA5_HUMAN (SEQ ID NO:1451)

Sequence documentation:

Alignment of: HUMCEA_PEA__1_P19 (SEQ ID NO:1383) x CEA5_HUMAN (SEQ ID NO:1451) . . .

Alignment segment 1/1:

| | | | |
|---|---|---|---|
| Quality: | 3298.00 | Escore: | 0 |
| Matching length: | 346 | Total length: | 702 |
| Matching Percent Similarity: | 100.00 | Matching Percent Identity: | 100.00 |
| Total Percent Similarity: | 49.29 | Total Percent Identity: | 49.29 |
| Gaps: | 1 | | |

Alignment:

```
  1 MESPSAPPHRWCIPWQRLLLTASLLTFWNPPTTAKLTIESTPFNVAEGKE  50
    ||||||||||||||||||||||||||||||||||||||||||||||||||
  1 MESPSAPPHRWCIPWQRLLLTASLLTFWNPPTTAKLTIESTPFNVAEGKE  50

51 VLLLVHNLPQHLFGYSWYKGERVDGNRQIIGYVIGTQQATPGPAYSGREI 100
    ||||||||||||||||||||||||||||||||||||||||||||||||||
 51 VLLLVHNLPQHLFGYSWYKGERVDGNRQIIGYVIGTQQATPGPAYSGREI 100

101 IYPNASLLIQNIIQNDTGFYTLHVIKSDLVNEEATGQFRVYPELPKPSIS 150
    ||||||||||||||||||||||||||||||||||||||||||||||||||
101 IYPNASLLIQNIIQNDTGFYTLHVIKSDLVNEEATGQFRVYPELPKPSIS 150

151 SNNSKPVEDKDAVAFTCEPETQDATYLWWVNNQSLPVSPRLQLSNGNRTL 200
    ||||||||||||||||||||||||||||||||||||||||||||||||||
151 SNNSKPVEDKDAVAFTCEPETQDATYLWWVNNQSLPVSPRLQLSNGNRTL 200

201 TLFNVTRNDTASYKCETQNPVSARRSDSVILN.................. 232
    |||||||||||||||||||||||||||||||
201 TLFNVTRNDTASYKCETQNPVSARRSDSVILNVLYGPDAPTISPLNTSYR 250

232 ..................................................  232

251 SGENLNLSCHAASNPPAQYSWFVNGTFQQSTQELFIPNITVNNSGSYTCQ 300

232 ..................................................  232

301 AHNSDTGLNRTTVTTITVYAEPPKPFITSNNSNPVEDEDAVALTCEPEIQ 350
```

```
232 .................................................. 232
351 NTTYLWWVNNQSLPVSPRLQLSNDNRTLTLLSVTRNDVGPYECGIQNELS  400

232 .................................................. 232
401 VDHSDPVILNVLYGPDDPTISPSYTYYRPGVNLSLSCHAASNPPAQYSWL  450

232 .................................................. 232
451 IDGNIQQHTQELFISNITEKNSGLYTCQANNSASGHSRTTVKTITVSAEL  500

232 .................................................. 232
501 PKPSISSNNSKPVEDKDAVAFTCEPEAQNTTYLWWVNGQSLPVSPRLQLS  550

233 ........................................VLYGPDTPIISP  244
551 NGNRTLTLFNVTRNDARAYVCGIQNSVSANRSDPVTLDVLYGPDTPIISP  600

245 PDSSYLSGANLNLSCHSASNPSPQYSWRINGIPQQHTQVLFIAKITPNNN  294
    ||||||||||||||||||||||||||||||||||||||||||||||||||
601 PDSSYLSGANLNLSCHSASNPSPQYSWRINGIPQQHTQVLFIAKITPNNN  650

295 GTYACFVSNLATGRNNSIVKSITVSASGTSPGLSAGATVGIMIGVLVGVA  344
    ||||||||||||||||||||||||||||||||||||||||||||||||||
651 GTYACFVSNLATGRNNSIVKSITVSASGTSPGLSAGATVGIMIGVLVGVA  700

345 LI  346
    ||
701 LI  702
```

Sequence name: CEA5_HUMAN (SEQ ID NO:1451)

Sequence documentation:

Alignment of: HUMCEA_PEA__1_P20 (SEQ ID NO:1384) x CEA5_HUMAN (SEQ ID NO:1451) . . .

Alignment segment 1/1:

| Quality: | 3294.00 | Escore: | 0 |
|---|---|---|---|
| Matching length: | 346 | Total length: | 702 |
| Matching Percent Similarity: | 100.00 | Matching Percent Identity: | 100.00 |
| Total Percent Similarity: | 49.29 | Total Percent Identity: | 49.29 |
| Gaps: | 1 | | |

Alignment:

```
  1 MESPSAPPHRWCIPWQRLLLTASLLTFWNPPTTAKLTIESTPFNVAEGKE   50
    ||||||||||||||||||||||||||||||||||||||||||||||||||
  1 MESPSAPPHRWCIPWQRLLLTASLLTFWNPPTTAKLTIESTPFNVAEGKE   50

51 VLLLVHNLPQHLFGYSWYKGERVDGNRQIIGYVIGTQQATPGPAYSGREI  100
    ||||||||||||||||||||||||||||||||||||||||||||||||||
 51 VLLLVHNLPQHLFGYSWYKGERVDGNRQIIGYVIGTQQATPGPAYSGREI  100

101 IYPNASLLIQNIIQNDTGFYTLHVIKSDLVNEEATGQFRVYP........  142
    |||||||||||||||||||||||||||||||||||||||||
101 IYPNASLLIQNIIQNDTGFYTLHVIKSDLVNEEATGQFRVYPELPKPSIS  150

142 ..................................................  142
151 SNNSKPVEDKDAVAFTCEPETQDATYLWWVNNQSLPVSPRLQLSNGNRTL  200

142 ..................................................  142
201 TLFNVTRNDTASYKCETQNPVSARRSDSVILNVLYGPDAPTISPLNTSYR  250

142 ..................................................  142
251 SGENLNLSCHAASNPPAQYSWFVNGTFQQSTQELFIPNITVNNSGSYTCQ  300

142 ..................................................  142
301 AHNSDTGLNRTTVTTITVYAEPPKPFITSNNSNPVEDEDAVALTCEPEIQ  350

142 ..................................................  142
351 NTTYLWWVNNQSLPVSPRLQLSNDNRTLTLLSVTRNDVGPYECGIQNELS  400
```

-continued

```
142  ..............................................        142
401  VDHSDPVILNVLYGPDDPTISPSYTYYRPGVNLSLSCHAASNPPAQYSWL       450

143  ..............................................EL       144
451  IDGNIQQHTQELFISNITEKNSGLYTCQANNSASGHSRTTVKTITVSAEL       500

145  PKPSISSNNSKPVEDKDAVAFTCEPEAQNTTYLWWVNGQSLPVSPRLQLS       194
     |||||||||||||||||||||||||||||||||||||||||||||||||
501  PKPSISSNNSKPVEDKDAVAFTCEPEAQNTTYLWWVNGQSLPVSPRLQLS       550

195  NGNRTLTLFNVTRNDARAYVCGIQNSVSANRSDPVTLDVLYGPDTPIISP       244
     |||||||||||||||||||||||||||||||||||||||||||||||||
551  NGNRTLTLFNVTRNDARAYVCGIQNSVSANRSDPVTLDVLYGPDTPIISP       600

245  PDSSYLSGANLNLSCHSASNPSPQYSWRINGIPQQHTQVLFIAKITPNNN       294
     |||||||||||||||||||||||||||||||||||||||||||||||||
601  PDSSYLSGANLNLSCHSASNPSPQYSWRINGIPQQHTQVLFIAKITPNNN       650

295  GTYACFVSNLATGRNNSIVKSITVSASGTSPGLSAGATVGIMIGVLVGVA       344
     |||||||||||||||||||||||||||||||||||||||||||||||||
651  GTYACFVSNLATGRNNSIVKSITVSASGTSPGLSAGATVGIMIGVLVGVA       700
345  LI                                                     346
     ||
701  LI                                                     702
```

Description for Cluster R35137

Cluster R35137 features 6 transcript(s) and 20 segment(s) of interest, the names for which are given in Tables 969 and 970, respectively, the sequences themselves are given at the end of the application. The selected protein variants are given in table 971.

TABLE 969

Transcripts of interest

| Transcript Name | Sequence ID No. |
| --- | --- |
| R35137_PEA_1_PEA_1_PEA_1_T3 | 114 |
| R35137_PEA_1_PEA_1_PEA_1_T5 | 115 |
| R35137_PEA_1_PEA_1_PEA_1_T10 | 116 |
| R35137_PEA_1_PEA_1_PEA_1_T11 | 117 |
| R35137_PEA_1_PEA_1_PEA_1_T12 | 118 |
| R35137_PEA_1_PEA_1_PEA_1_T14 | 119 |

TABLE 970

Segments of interest

| Segment Name | Sequence ID No. |
| --- | --- |
| R35137_PEA_1_PEA_1_PEA_1_node_2 | 856 |
| R35137_PEA_1_PEA_1_PEA_1_node_3 | 857 |
| R35137_PEA_1_PEA_1_PEA_1_node_9 | 858 |
| R35137_PEA_1_PEA_1_PEA_1_node_11 | 859 |
| R35137_PEA_1_PEA_1_PEA_1_node_16 | 860 |
| R35137_PEA_1_PEA_1_PEA_1_node_18 | 861 |
| R35137_PEA_1_PEA_1_PEA_1_node_20 | 862 |
| R35137_PEA_1_PEA_1_PEA_1_node_27 | 863 |
| R35137_PEA_1_PEA_1_PEA_1_node_5 | 864 |
| R35137_PEA_1_PEA_1_PEA_1_node_7 | 865 |
| R35137_PEA_1_PEA_1_PEA_1_node_12 | 866 |
| R35137_PEA_1_PEA_1_PEA_1_node_14 | 867 |
| R35137_PEA_1_PEA_1_PEA_1_node_15 | 868 |
| R35137_PEA_1_PEA_1_PEA_1_node_17 | 869 |
| R35137_PEA_1_PEA_1_PEA_1_node_21 | 870 |
| R35137_PEA_1_PEA_1_PEA_1_node_22 | 871 |
| R35137_PEA_1_PEA_1_PEA_1_node_23 | 872 |
| R35137_PEA_1_PEA_1_PEA_1_node_24 | 873 |
| R35137_PEA_1_PEA_1_PEA_1_node_25 | 874 |
| R35137_PEA_1_PEA_1_PEA_1_node_26 | 875 |

TABLE 971

Proteins of interest

| Protein Name | Sequence ID No. | Corresponding Transcript(s) |
| --- | --- | --- |
| R35137_PEA_1_PEA_1_PEA_1_P9 | 1385 | R35137_PEA_1_PEA_1_PEA_1_T10 (SEQ ID NO:116); R35137_PEA_1_PEA_1_PEA_1_T12 (SEQ ID NO:118) |
| R35137_PEA_1_PEA_1_PEA_1_P8 | 1386 | R35137_PEA_1_PEA_1_PEA_1_T11 (SEQ ID NO:117) |
| R35137_PEA_1_PEA_1_PEA_1_P11 | 1387 | R35137_PEA_1_PEA_1_PEA_1_T14 (SEQ ID NO:119) |
| R35137_PEA_1_PEA_1_PEA_1_P2 | 1388 | R35137_PEA_1_PEA_1_PEA_1_T3 (SEQ ID NO:114) |
| R35137_PEA_1_PEA_1_PEA_1_P4 | 1389 | R35137_PEA_1_PEA_1_PEA_1_T5 (SEQ ID NO:115) |

These sequences are variants of the known protein Alanine aminotransferase (SwissProt accession identifier ALAT_HUMAN; known also according to the synonyms EC 2.6.1.2; Glutamic—pyruvic transaminase; GPT; Glutamic—alanine transaminase), SEQ ID NO:1452, referred to herein as the previously known protein.

Protein Alanine aminotransferase (SEQ ID NO:1452) is known or believed to have the following function(s): Participates in cellular nitrogen metabolism and also in liver gluconeogenesis starting with precursors transported from skeletal muscles. The sequence for protein Alanine aminotransferase is given at the end of the application, as "Alanine aminotransferase amino acid sequence". Known polymorphisms for this sequence are as shown in Table 972.

TABLE 972

Amino acid mutations for Known Protein

| SNP position(s) on amino acid sequence | Comment |
|---|---|
| 13 | H -> N (in allele GPT*2; dbSNP:1063739)./ FTId=VAR_000561. |
| 3-6 | STGD -> RRGN |
| 38 | G -> S |
| 221 | A -> H |

Protein Alanine aminotransferase (SEQ ID NO:1452) localization is believed to be Cytoplasmic.

Cluster R35137 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 34 refer to weighted expression of ESTs in each category, as "parts per million" (ratio of the expression of ESTs for a particular cluster to the expression of all ESTs in that category, according to parts per million).

Figure 34:
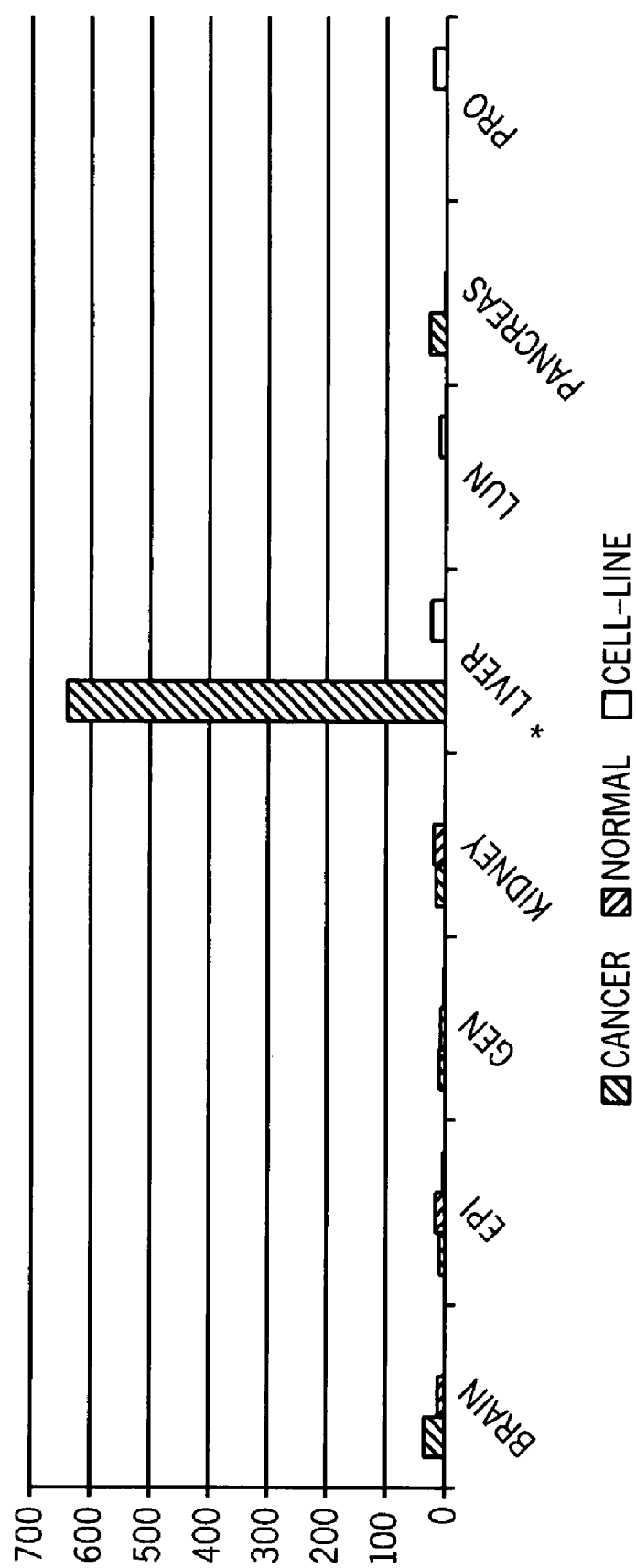
FIG. 34 is a histogram showing Cancer and cell-line vs. normal tissue expression for Cluster R35137, demonstrating overexpression in hepatocellular carcinoma.

Overall, the following results were obtained as shown with regard to the histograms in FIG. 34 and Table 973. This cluster is overexpressed (at least at a minimum level) in the following pathological conditions: hepatocellular carcinoma.

TABLE 973

Normal tissue distribution

| Name of Tissue | Number |
|---|---|
| brain | 12 |
| epithelial | 16 |
| general | 8 |
| kidney | 20 |
| liver | 0 |
| lung | 0 |
| pancreas | 2 |
| prostate | 0 |

TABLE 974

P values and ratios or expression in cancerous tissue

| Name of Tissue | P1 | P2 | SP1 | R3 | SP2 | R4 |
|---|---|---|---|---|---|---|
| brain | 3.2e–01 | 4.8e–01 | 1.8e–01 | 2.5 | 4.2e–01 | 1.5 |
| epithelial | 7.6e–01 | 7.7e–01 | 8.9e–01 | 0.5 | 9.8e–01 | 0.4 |
| general | 6.7e–01 | 8.2e–01 | 4.2e–01 | 1.0 | 8.5e–01 | 0.7 |
| kidney | 8.6e–01 | 9.0e–01 | 5.8e–01 | 0.9 | 7.0e–01 | 0.8 |
| liver | 1.8e–01 | 4.5e–01 | 3.0e–03 | 7.6 | 1.6e–01 | 2.3 |
| lung | 1 | 6.3e–01 | 1 | 1.0 | 6.2e–01 | 1.6 |

TABLE 974-continued

P values and ratios or expression in cancerous tissue

| Name of Tissue | P1 | P2 | SP1 | R3 | SP2 | R4 |
|---|---|---|---|---|---|---|
| pancreas | 2.3e–01 | 4.0e–01 | 1.8e–01 | 3.1 | 2.8e–01 | 2.3 |
| prostate | 1 | 7.8e–01 | 1 | 1.0 | 7.5e–01 | 1.3 |

As noted above, cluster R35137 features 6 transcript(s), which were listed in Table 969 above. These transcript(s) encode for protein(s) which are variant(s) of protein Alanine aminotransferase (SEQ ID NO:1452). A description of each variant protein according to the present invention is now provided.

Variant protein R35137_PEA_1_PEA_1_PEA_1_P9 (SEQ ID NO:1385) according to the present invention has an amino acid sequence as given at the end of the application; it is encoded by transcript(s) R35137_PEA_1_PEA_1_PEA_1_T10 (SEQ ID NO:116). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison report between R35137_PEA_1_PEA_1_PEA_1_P9 (SEQ ID NO:1385) and ALAT_HUMAN_V1 (SEQ ID NO:1453):

1. An isolated chimeric polypeptide encoding for R35137_PEA_1_PEA_1_PEA_1_P9 (SEQ ID NO:1385), comprising a first amino acid sequence being at least 90% homologous to MASSTGDRSQAVRHGLRAKVLTLDG-MNPRVRRVEYAVRGPIVQRALELEQELRQGVKKPFT-EVIRANIGD AQAMGQRPITFLRQVLALCVNP-DLLSSPNFPDDAKKRAERILQACGGHSLGAYSVSSGI-QLIREDVARYIER RDGGIPADPNNVFLSTGAS-DAIVTVLKLLVAGEGHTRTGVLIPIPQYPLYSATLAE-LGAVQVDYYLDEERA WALDVAELHRALGQARDH-CRPRALCVINPGNPTGQVQTRECIEAVIRFAFEERLF-LLADEV corresponding to amino acids 1-274 of ALAT_HUMAN_V1 (SEQ ID NO:1453), which also corresponds to amino acids 1-274 of R35137_PEA_1_PEA_1_PEA_1_P9 (SEQ ID NO:1385), and a second amino acid sequence being at least 70%, optionally at least 80%, preferably at least 85%, more preferably at least 90% and most preferably at least 95% homologous to a polypeptide having the sequence RGAGEREAGQQSAPVTP-CALPGVPGQRVRRGFAVPLIQEGAHGD-GAALRRAAGACLLPLHLQGLHGRVRAYEAGGGSRA-MARPSSPDGPPPPPHLTWPCAGAGSAAAMWRW (SEQ ID NO:1737) corresponding to amino acids 275-385 of R35137_PEA_1_PEA_1_PEA_1_P9 (SEQ ID NO:1385), wherein said first amino acid sequence and second amino acid sequence are contiguous and in a sequential order.

2. An isolated polypeptide encoding for a tail of R35137_PEA_1_PEA_1_PEA_1_P9 (SEQ ID NO:1385), comprising a polypeptide being at least 70%, optionally at least about 80%, preferably at least about 85%, more preferably at least about 90% and most preferably at least about 95% homologous to the sequence RGAGEREAGQQSAPVTPCALPGVPGQRVRRGFAV-PLIQEGAHGDGAALRRAAGACLLPLHLQGLHGRVR AYEAGGGSRAMARPSSPDGPPPPPHLTWPCAGAG-SAAAMWRW (SEQ ID NO:1737) in R35137_PEA_1_PEA_1_PEA_1_P9 (SEQ ID NO:1385).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 975

Changes to ALAT_HUMAN_V1 (SEQ ID NO:1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P9 (SEQ ID NO:1385) is encoded by the following transcript(s): R35137_PEA_1_PEA_1_PEA_1_T10 (SEQ ID NO:116), for which the sequence(s) is/are given at the end of the application. The coding portion of transcript R35137_PEA_1_PEA_1_PEA_1_T10 (SEQ ID NO:116) is shown in bold; this coding portion starts at position 271 and ends at position 1425. The transcript also has the following SNPs as listed in Table 976 (given according to their position on the nucleotide sequence, with the alternative nucleic acid listed; the last column indicates whether the SNP is known or not; the presence of known SNPs in variant protein R35137_PEA_1_PEA_1_PEA_1_P9 (SEQ ID NO:1385) sequence provides support for the deduced sequence of this variant protein according to the present invention).

TABLE 976

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1225 | G -> | No |
| 1745 | T -> G | No |
| 1957 | C -> | No |
| 2018 | G -> A | No |
| 2019 | C -> A | No |
| 2101 | A -> G | No |
| 2102 | A -> G | No |
| 2159 | C -> T | Yes |
| 2710 | G -> C | No |
| 2789 | C -> A | Yes |
| 3622 | G -> A | Yes |

Variant protein R35137_PEA_1_1PEA_1_PEA_1_P8 (SEQ ID NO:1386) according to the present invention has an amino acid sequence as given at the end of the application; it is encoded by transcript(s) R35137_PEA_1_PEA_1_PEA_1_T11 (SEQ ID NO:117). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison report between R35137_PEA_1_PEA_1_PEA_1_P8 (SEQ ID NO:1386) and ALAT_HUMAN_V1 (SEQ ID NO:1453):

1. An isolated chimeric polypeptide encoding for R35137_PEA_1_PEA_1_PEA_1_P8 (SEQ ID NO:1386), comprising a first amino acid sequence being at least 90% homologous to MASSTGDRSQAVRHGLPAKVLTLDGM-NPRVRRVEYAVRGPIVQRALELEQEL-RQGVKKPFTEVIRANIGD AQAMGQRPITFLRQVLAL-CVNPDLLSSPNFPDDAKKRAERILQACGGHSLGAYS-VSSGIQLIREDVARYIER RDGGIPADPNNVFLSTGAS-DAIVTVLKLLVAGEGHTRTGVLIPIPQY-PLYSATLAELGAVQVDYYLDEERA WALDVAEL-HRALGQARDHCRPRALCVINPGNPTGQVQTRECIEA-VIRFAFEERLFLLADEVYQDNVYAAG SQFHSFKKV-LMEMGPPYAGQQELASFHSTSKGYMGEC corresponding to amino acids 1-320 of ALAT_HUMAN_V1 (SEQ ID NO:1453), which also corresponds to amino acids 1-320 of R35137_PEA_1_PEA_1_PEA_1_P8 (SEQ ID NO:1386), and a second amino acid sequence being at least 70%, optionally at least 80%, preferably at least 85%, more preferably at least 90% and most preferably at least 95% homologous to a polypeptide having the sequence VRTRRVGARGPWPGP-PRPMGHPLLRT (SEQ ID NO:1738) corresponding to amino acids 321-346 of R35137_PEA_1_PEA_1_PEA_1_P8 (SEQ ID NO:1386), wherein said first amino acid sequence and second amino acid sequence are contiguous and in a sequential order.

2. An isolated polypeptide encoding for a tail of R35137_PEA_1_PEA_1_PEA_1_P8 (SEQ ID NO:1386), comprising a polypeptide being at least 70%, optionally at least about 80%, preferably at least about 85%, more preferably at least about 90% and most preferably at least about 95% homologous to the sequence VRTRRVGARGPWPGP-PRPMGHPLLRT (SEQ ID NO:1738) in R35137_PEA_1_PEA_1_PEA_1_P8 (SEQ ID NO:1386).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 977

Changes to ALAT_HUMAN_V1 (SEQ ID NO:1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P8 (SEQ ID NO:1386) also has the following non-silent SNPs (Single Nucleotide Polymorphisms) as listed in Table 978, (given according to their position(s) on the amino acid sequence, with the alternative amino acid(s) listed; the last column indicates whether the SNP is known or not; the presence of known SNPs in variant protein R35137_PEA_1_PEA_1_PEA_1_P8 (SEQ ID NO:1386) sequence provides support for the deduced sequence of this variant protein according to the present invention).

TABLE 978

Amino acid mutations

| SNP position(s) on amino acid sequence | Alternative amino acid(s) | Previously known SNP? |
|---|---|---|
| 14 | H -> N | Yes |
| 54 | Q -> | No |
| 233 | R -> | No |
| 296 | M -> | No |

Variant protein R35137_PEA_1_PEA_1_PEA_1_P8 (SEQ ID NO:1386) is encoded by the following transcript(s): R35137_PEA_1_PEA_1_PEA_1_T11 (SEQ ID NO:117), for which the sequence(s) is/are given at the end of the application. The coding portion of transcript R35137_PEA_1_PEA_1_PEA_1_T11 (SEQ ID NO:117) is shown in bold; this coding portion starts at position 271 and ends at position 1308. The transcript also has the following SNPs as listed in Table 979 (given according to their position on the nucleotide sequence, with the alternative nucleic acid listed; the last column indicates whether the SNP is known or not; the presence of known SNPs in variant protein R35137_PEA_1_PEA_1_PEA_1_P8 (SEQ ID NO:1386) sequence provides support for the deduced sequence of this variant protein according to the present invention).

TABLE 979

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1158 | G -> | No |
| 1752 | T -> G | No |
| 2030 | C -> | No |
| 2091 | G -> A | No |
| 2092 | C -> A | No |
| 2174 | A -> G | No |
| 2175 | A -> G | No |
| 2232 | C -> T | Yes |
| 2783 | G -> C | No |
| 2862 | C -> A | Yes |
| 3695 | G -> A | Yes |

Variant protein R35137_PEA_1_PEA_1_PEA_1_P11 (SEQ ID NO:1387) according to the present invention has an amino acid sequence as given at the end of the application; it is encoded by transcript(s) R35137_PEA_1_PEA_1_PEA_1_T14 (SEQ ID NO:119). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison report between R35137_PEA_1_PEA_1_PEA_1_P11 (SEQ ID NO:1387) and ALAT_HUMAN_V1 (SEQ ID NO:1453):

1. An isolated chimeric polypeptide encoding for R35137_PEA_1_PEA_1_PEA_1_P11 (SEQ ID NO:1387), comprising a first amino acid sequence being at least 90% homologous to MASSTGDRSQAVRHGLRAKV-LTLDGMNPRVRRVEYAVRGPIVQRALELEQELRQG-VKKPFTEVIRANIGD AQAMGQRPITFLRQVLALCVN-PDLLSSPNFPDDAKKRAERILQACGGH-SLGAYSVSSGIQLIREDVARYIER RDGGIPADPNNVFL-STGASDAIVTVLKLLVAGEGHTRTGVLIPIPQYPLYSAT-LAELGAVQVDYYLDEERA WALDVAELHRALGQAR corresponding to amino acids 1-229 of ALAT_HUMAN_V1 (SEQ ID NO:1453), which also corresponds to amino acids 1-229 of R35137_PEA_1_PEA_1_PEA_1_P11 (SEQ ID NO:1387), and a second amino acid sequence being at least 90% homologous to SGFGQREGTYHFRMTILPPLEKLR-LLLEKLSRFHAKFTLEYS corresponding to amino acids 455-496 of ALAT_HUMAN_V1 (SEQ ID NO:1453), which also corresponds to amino acids 230-271 of R35137_PEA_1_PEA_1_PEA_1_P11 (SEQ ID NO:1387), wherein said first amino acid sequence and second amino acid sequence are contiguous and in a sequential order.

2. An isolated chimeric polypeptide encoding for an edge portion of R35137_PEA_1_PEA_1_PEA_1_P11 (SEQ ID NO:1387), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RS, having a structure as follows: a sequence starting from any of amino acid numbers 229-x to 229; and ending at any of amino acid numbers 230+((n−2)−x), in which x varies from 0 to n−2.

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 980

Changes to ALAT_HUMAN_V1 (SEQ ID NO:1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P11 (SEQ ID NO:1387) also has the following non-silent SNPs (Single Nucleotide Polymorphisms) as listed in Table 981, (given according to their position(s) on the amino acid sequence, with the alternative amino acid(s) listed; the last column indicates whether the SNP is known or not; the presence of known SNPs in variant protein R35137_PEA_1_PEA_1_PEA_1_P11 (SEQ ID NO:1387) sequence provides support for the deduced sequence of this variant protein according to the present invention).

TABLE 981

Amino acid mutations

| SNP position(s) on amino acid sequence | Alternative amino acid(s) | Previously known SNP? |
|---|---|---|
| 14 | H -> N | Yes |
| 54 | Q -> | No |

Variant protein R35137_PEA_1_PEA_1_PEA_1_P11 (SEQ ID NO:1387) is encoded by the following transcript(s): R35137_PEA_1_PEA_1_PEA_1_T14 (SEQ ID NO:119), for which the sequence(s) is/are given at the end of the application. The coding portion of transcript R35137_PEA_1_PEA_1_PEA_1_T14 (SEQ ID NO:119) is shown in bold; this coding portion starts at position 271 and ends at position 1083. The transcript also has the following SNPs as listed in Table 982 (given according to their position on the nucleotide sequence, with the alternative nucleic acid listed; the last column indicates whether the SNP is known or not; the presence of known SNPs in variant protein R35137_PEA_1_PEA_1_PEA_1_P11 (SEQ ID NO:1387) sequence provides support for the deduced sequence of this variant protein according to the present invention).

TABLE 982

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 1115 | C -> | No |
| 1176 | G -> A | No |
| 1177 | C -> A | No |

Variant protein R35137_PEA_1_PEA_1_PEA_1_P2 (SEQ ID NO:1388) according to the present invention has an amino acid sequence as given at the end of the application; it is encoded by transcript(s) R35137_PEA_1_PEA_1_PEA_1_T3 (SEQ ID NO:114). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison report between R35137_PEA_1_PEA_1_PEA_1_P2 (SEQ ID NO:1388) and ALAT_HUMAN_V1 (SEQ ID NO:1453):

1. An isolated chimeric polypeptide encoding for R35137_PEA_1_PEA_1_PEA_1_P2 (SEQ ID NO:1388), comprising a first amino acid sequence being at least 90% homologous to MASSTGDRSQAVRHGLRAKVLTLDG-MNPRVRRVEYAVRGPIVQRALELEQELRQGVKKPF-TEVIRANIGD AQAMGQRPITFLRQVLALCVNP-DLLSSPNFPDDAKKRAERILQACGGHSLGAYSVSSG-IQLIREDVARYIER RDGGIPADPNNVFLSTGAS-DAIVTVLKLLVAGEGHTRTGVLIPIPQYPLYSATLA-ELGAVQVDYYLDEERA WALDVAELHRALGQARDH-CRPRALCVINPGNPTGQVQTRECIEAVIRFAFEER-LFLLADEV corresponding to amino acids 1-274 of ALAT_HUMAN_V1 (SEQ ID NO:1453), which also corresponds to amino acids 1-274 of R35137_PEA_1_PEA_1_PEA_1_P2 (SEQ ID NO:1388), and a second amino acid sequence being at least 70%, optionally at least 80%, preferably at least 85%, more preferably at least 90% and most preferably at least 95% homologous to a polypeptide having the sequence RGAGEREAGQQSAPVTPCALPGVPGQ-RVRRGFAVPLIQEGAHGDGAALRRAAGACLLPL-HLQGLHGRVR VPRRLCGGGEHGRCSAAADAEAD-ECAAVPAGARTGPAGPGGQPARAHRPLLCAVPG (SEQ ID NO:1739) corresponding to amino acids 275-399 of R35137_PEA_1_PEA_1_PEA_1_P2 (SEQ ID NO:1388), wherein said first amino acid sequence and second amino acid sequence are contiguous and in a sequential order.

2. An isolated polypeptide encoding for a tail of R35137_PEA_1_PEA_1_PEA_1_P2 (SEQ ID NO:1388), comprising a polypeptide being at least 70%, optionally at least about 80%, preferably at least about 85%, more preferably at least about 90% and most preferably at least about 95% homologous to the sequence RGAGEREAGQQSAPVTPCALPGVPGQRVRRGFAV-PLIQEGAHGDGAALRRAAGACLLPLHLQGLHGRVR VPRRLCGGGEHGRCSAAADAEADECAAVPAGAR-TGPAGPGGQPARAHRPLLCAVPG (SEQ ID NO:1739) in R35137_PEA_1_PEA_1_PEA_1_P2(SEQ ID NO:1388).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 983

Changes to ALAT_HUMAN_V1 (SEQ ID NO:1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P2 (SEQ ID NO:1388) also has the following non-silent SNPs (Single Nucleotide Polymorphisms) as listed in Table 984, (given according to their position(s) on the amino acid sequence, with the alternative amino acid(s) listed; the last column indicates whether the SNP is known or not; the presence of known SNPs in variant protein R35137_PEA_1_PEA_1_PEA_1_P2 (SEQ ID NO:1388) sequence provides support for the deduced sequence of this variant protein according to the present invention).

TABLE 984

Amino acid mutations

| SNP position(s) on amino acid sequence | Alternative amino acid(s) | Previously known SNP? |
|---|---|---|
| 14 | H -> N | Yes |
| 54 | Q -> | No |
| 233 | R -> | No |
| 319 | G -> | No |

Variant protein R35137_PEA_1_PEA_1_PEA_1_P2 (SEQ ID NO:1388) is encoded by the following transcript(s): R35137_PEA_1_PEA_1_PEA_1_T3 (SEQ ID NO:114), for which the sequence(s) is/are given at the end of the application. The coding portion of transcript R35137_PEA_1_PEA_1_PEA_1_T3 (SEQ ID NO:114) is shown in bold; this coding portion starts at position 271 and ends at position 1467. The transcript also has the following SNPs as listed in Table 985 (given according to their position on the nucleotide sequence, with the alternative nucleic acid listed; the last column indicates whether the SNP is known or not; the presence of known SNPs in variant protein R35137_PEA_1_PEA_1_PEA_1_P2 (SEQ ID NO:1388) sequence provides support for the deduced sequence of this variant protein according to the present invention).

TABLE 985

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1225 | G -> | No |
| 1645 | T -> G | No |
| 1857 | C -> | No |
| 1918 | G -> A | No |
| 1919 | C -> A | No |
| 2001 | A -> G | No |
| 2002 | A -> G | No |
| 2059 | C -> T | Yes |
| 2610 | G -> C | No |
| 2689 | C -> A | Yes |
| 3522 | G -> A | Yes |

Variant protein R35137_PEA_1_PEA_1_PEA_1_P4 (SEQ ID NO:1389) according to the present invention has an amino acid sequence as given at the end of the application; it is encoded by transcript(s) R35137_PEA_1_PEA_1_PEA_1_T5 (SEQ ID NO:115). An alignment is given to the known protein (Alanine aminotransferase (SEQ ID NO:1452)) at the end of the application. One or more alignments to one or more previously published protein sequences are given at the end of the application. A brief description of the relationship of the variant protein according to the present invention to each such aligned protein is as follows:

Comparison report between R35137_PEA_1_PEA_1_PEA_1_P4 (SEQ ID NO:1389) and ALAT_HUMAN_V1 (SEQ ID NO:1453):

1. An isolated chimeric polypeptide encoding for R35137_PEA_1_PEA_1_PEA_1_P4 (SEQ ID NO:1389), comprising a first amino acid sequence being at least 90% homologous to MASSTGDRSQAVRHGLRAKVLTLDG-MNPRVRRVEYAVRGPIVQRALELEQELRQGVKK-PFTEVIRANIGD AQAMGQRPITFLRQVLALCVNP-DLLSSPNFPDDAKKRAERILQACGGHSLGAYS-VSSGIQLIREDVARYIER RDGGIPADPNNVFLSTGAS-DAIVTVLKLLVAGEGHTRTGVLIPIPQYPLYSATLA-ELGAVQVDYYLDEERA WALDVAELHRALGQARDH-CRPRALCVINPGNPTGQVQTRECIEAVIRFAFEERL-FLLADEVYQDNVYAAG SQFHSFKKVLMEMGPPY-AGQQELASFHSTSKGYMGECGFRGGYVEVVNM-DAAVQQQMLKLMSVRLCPP VPGQALLDLVVSP-PAPTDPSFAQFQAEKQAVLAELAAKAKLTEQVFNE-APGISCNPVQGAMYSFPRVQLP PRAVERAQELGLAP-DMFFCLRLLEETGICVVPGSGFGQREGTYHFRMTI-LPPLEKLRLLLEKLSRFHAKFTL E corresponding to amino acids 1-494 of ALAT_HUMAN_V1 (SEQ ID NO:1453), which also corresponds to amino acids 1-494 of R35137_PEA_1_PEA_1_PEA_1_P4 (SEQ ID NO:1389), and a second amino acid sequence being at least 70%, optionally at least 80%, preferably at least 85%, more preferably at least 90% and most preferably at least 95% homologous to a polypeptide having the sequence SPGRLWSPLYLLLMPG-GVGWGGCWAPASLQVPNKAVWQSD-SKKEALAAAWPAPTCLPFLQA (SEQ ID NO:1740) corresponding to amino acids 495-555 of R35137_PEA_1_PEA_1_PEA_1_P4 (SEQ ID NO:1389), wherein said first amino acid sequence and second amino acid sequence are contiguous and in a sequential order.

2. An isolated polypeptide encoding for a tail of R35137_PEA_1_PEA_1_PEA_1_P4 (SEQ ID NO:1389), comprising a polypeptide being at least 70%, optionally at least about 80%, preferably at least about 85%, more preferably at least about 90% and most preferably at least about 95% homologous to the sequence SPGRLWSPLYLLLMPG-GVGWGGCWAPASLQVPNKAVWQSD-SKKEALAAAWPAPTCLPFLQA (SEQ ID NO:1740) in R35137_PEA_1_PEA_1_PEA_1_P4 (SEQ ID NO:1389).

It should be noted that the known protein sequence (ALAT_HUMAN (SEQ ID NO:1452)) has one or more changes than the sequence given at the end of the application and named as being the amino acid sequence for ALAT_HUMAN_V1 (SEQ ID NO:1453). These changes were previously known to occur and are listed in the table below.

TABLE 986

Changes to ALAT_HUMAN_V1 (SEQ ID NO:1453)

| SNP position(s) on amino acid sequence | Type of change |
|---|---|
| 1 | init_met |
| 222 | conflict |

The location of the variant protein was determined according to results from a number of different software programs and analyses, including analyses from SignalP and other specialized programs. The variant protein is believed to be located as follows with regard to the cell: intracellularly. The protein localization is believed to be intracellularly because neither of the trans-membrane region prediction programs predicted a trans-membrane region for this protein. In addition both signal-peptide prediction programs predict that this protein is a non-secreted protein.

Variant protein R35137_PEA_1_PEA_1_PEA_1_P4 (SEQ ID NO:1389) also has the following non-silent SNPs (Single Nucleotide Polymorphisms) as listed in Table 987, (given according to their position(s) on the amino acid sequence, with the alternative amino acid(s) listed; the last column indicates whether the SNP is known or not; the presence of known SNPs in variant protein R35137_PEA_1_PEA_1_PEA_1_P4 (SEQ ID NO:1389) sequence provides support for the deduced sequence of this variant protein according to the present invention).

TABLE 987

Amino acid mutations

| SNP position(s) on amino acid sequence | Alternative amino acid(s) | Previously known SNP? |
|---|---|---|
| 14 | H -> N | Yes |
| 54 | Q -> | No |
| 233 | R -> | No |
| 296 | M -> | No |
| 436 | D -> E | No |
| 508 | M -> I | No |
| 509 | P -> T | No |
| 536 | K -> R | No |

Variant protein R35137_PEA_1_PEA_1_PEA_1_P4 (SEQ ID NO:1389) is encoded by the following transcript(s): R35137_PEA_1_PEA_1_PEA_1_T5 (SEQ ID NO:115), for which the sequence(s) is/are given at the end of the application. The coding portion of transcript R35137_PEA_1_PEA_1_PEA_1_T5 (SEQ ID NO:115) is shown in bold; this coding portion starts at position 271 and ends at position 1935. The transcript also has the following SNPs as listed in Table 988 (given according to their position on the nucleotide sequence, with the alternative nucleic acid listed; the last column indicates whether the SNP is known or not; the presence of known SNPs in variant protein R35137_PEA_1_PEA_1_PEA_1_P4 (SEQ ID NO:1389) sequence provides support for the deduced sequence of this variant protein according to the present invention).

TABLE 988

Nucleic acid SNPs

| SNP position on nucleotide sequence | Alternative nucleic acid | Previously known SNP? |
|---|---|---|
| 230 | C -> T | No |
| 231 | C -> T | No |
| 310 | C -> A | Yes |
| 432 | G -> | No |
| 969 | C -> | No |
| 1158 | G -> | No |
| 1578 | T -> G | No |
| 1794 | G -> A | No |
| 1795 | C -> A | No |
| 1877 | A -> G | No |
| 1878 | A -> G | No |
| 1935 | C -> T | Yes |
| 2486 | G -> C | No |
| 2565 | C -> A | Yes |
| 3398 | G -> A | Yes |

As noted above, cluster R35137 features 20 segment(s), which were listed in Table 970 above and for which the sequence(s) are given at the end of the application. These segment(s) are portions of nucleic acid sequence(s) which are described herein separately because they are of particular interest. A description of each segment according to the present invention is now provided.

Segment cluster R35137_PEA_1_PEA_1_PEA_1_node_2 (SEQ ID NO:856) according to the present invention is supported by 19 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 989 below describes the starting and ending position of this segment on each transcript.

TABLE 989

Segment location on transcripts

| Transcript name | Segment starting position | Segment ending position |
|---|---|---|
| R35137_PEA_1_PEA_1_PEA_1_T3 (SEQ ID NO:114) | 1 | 266 |
| R35137_PEA_1_PEA_1_PEA_1_T5 (SEQ ID NO:115) | 1 | 266 |
| R35137_PEA_1_PEA_1_PEA_1_T10 (SEQ ID NO:116) | 1 | 266 |
| R35137_PEA_1_PEA_1_PEA_1_T11 (SEQ ID NO:117) | 1 | 266 |
| R35137_PEA_1_PEA_1_PEA_1_T12 (SEQ ID NO:118) | 1 | 266 |
| R35137_PEA_1_PEA_1_PEA_1_T14 (SEQ ID NO:119) | 1 | 266 |

Segment cluster R35137_PEA_1_PEA_1_PEA_1_node_3 (SEQ ID NO:857) according to the present invention is supported by 24 libraries. The number of libraries was determined as previously described. This segment can be found in the following transcript(s): R35137_PEA_1_PEA_1_PEA_1_T3 (SEQ ID NO:114), R35137PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 990 below describes the starting and ending position of this segment on each transcript.

TABLE 990

Segment location on transcripts

| Transcript name | Segment starting position | Segment ending position |
|---|---|---|
| R35137_PEA_1_PEA_1_PEA_1_T3 (SEQ ID NO:114) | 267 | 432 |
| R35137_PEA_1_PEA_1_PEA_1_T5 (SEQ ID NO:115) | 267 | 432 |
| R35137_PEA_1_PEA_1_PEA_1_T10 (SEQ ID NO:116) | 267 | 432 |
| R35137_PEA_1_PEA_1_PEA_1_T11 (SEQ ID NO:117) | 267 | 432 |
| R35137_PEA_1_PEA_1_PEA_1_T12 (SEQ ID NO:118) | 267 | 432 |
| R35137_PEA_1_PEA_1_PEA_1_T14 (SEQ ID NO:119) | 267 | 432 |

Segment cluster R35137_PEA_1_PEA_1_PEA_1_node_9 (SEQ ID NO:858) according to the present invention is supported by 25 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 991 below describes the starting and ending position of this segment on each transcript.

TABLE 991

Segment location on transcripts

| Transcript name | Segment starting position | Segment ending position |
|---|---|---|
| R35137_PEA_1_PEA_1_PEA_1_T3 (SEQ ID NO:114) | 632 | 765 |
| R35137_PEA_1_PEA_1_PEA_1_T5 (SEQ ID NO:115) | 632 | 765 |
| R35137_PEA_1_PEA_1_PEA_1_T10 (SEQ ID NO:116) | 632 | 765 |
| R35137_PEA_1_PEA_1_PEA_1_T11 (SEQ ID NO:117) | 632 | 765 |
| R35137_PEA_1_PEA_1_PEA_1_T12 (SEQ ID NO:118) | 632 | 765 |
| R35137_PEA_1_PEA_1_PEA_1_T14 (SEQ ID NO:119) | 632 | 765 |

Segment cluster R35137_PEA_1_PEA_1_PEA_1_node_11 (SEQ ID NO:859) according to the present invention is supported by 30 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 992 below describes the starting and ending position of this segment on each transcript.

TABLE 992

Segment location on transcripts

| Transcript name | Segment starting position | Segment ending position |
|---|---|---|
| R35137_PEA_1_PEA_1_PEA_1_T3 (SEQ ID NO:114) | 766 | 955 |
| R35137_PEA_1_PEA_1_PEA_1_T5 (SEQ ID NO:115) | 766 | 955 |
| R35137_PEA_1_PEA_1_PEA_1_T10 (SEQ ID NO:116) | 766 | 955 |
| R35137_PEA_1_PEA_1_PEA_1_T11 (SEQ ID NO:117) | 766 | 955 |
| R35137_PEA_1_PEA_1_PEA_1_T12 (SEQ ID NO:118) | 766 | 955 |
| R35137_PEA_1_PEA_1_PEA_1_T14 (SEQ ID NO:119) | 766 | 955 |

Segment cluster R35137_PEA_1_PEA_1_PEA_1_node_16 (SEQ ID NO:860) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T11 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 993 below describes the starting and ending position of this segment on each transcript.

TABLE 993

Segment location on transcripts

| Transcript name | Segment starting position | Segment ending position |
|---|---|---|
| R35137_PEA_1_PEA_1_PEA_1_T3 (SEQ ID NO:114) | 1157 | 1293 |
| R35137_PEA_1_PEA_1_PEA_1_T5 (SEQ ID NO:115) | 1090 | 1226 |
| R35137_PEA_1_PEA_1_PEA_1_T10 (SEQ ID NO:116) | 1157 | 1293 |
| R35137_PEA_1_PEA_1_PEA_1_T11 (SEQ ID NO:117) | 1090 | 1226 |
| R35137_PEA_1_PEA_1_PEA_1_T12 (SEQ ID NO:118) | 1157 | 1293 |

Segment cluster R35137_PEA_1_PEA_1_PEA_1_node_18 (SEQ ID NO:861) according to the present invention is supported by 24 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 994 below describes the starting and ending position of this segment on each transcript.

TABLE 994

Segment location on transcripts

| Transcript name | Segment starting position | Segment ending position |
|---|---|---|
| R35137_PEA_1_PEA_1_PEA_1_T3 (SEQ ID NO:114) | 1294 | 1468 |
| R35137_PEA_1_PEA_1_PEA_1_T5 (SEQ ID NO:115) | 1227 | 1401 |
| R35137_PEA_1_PEA_1_PEA_1_T10 (SEQ ID NO:116) | 1394 | 1568 |
| R35137_PEA_1_PEA_1_PEA_1_T11 (SEQ ID NO:117) | 1327 | 1501 |
| R35137_PEA_1_PEA_1_PEA_1_T12 (SEQ ID NO:118) | 1394 | 1568 |

Microarray (chip) data is also available for this segment as follows. As described above with regard to the cluster itself, various oligonucleotides were tested for being differentially expressed in various disease conditions, particularly cancer. The following oligonucleotides were found to hit this segment (in relation to lung cancer), shown in Table 995.

TABLE 995

Oligonucleotides related to this segment

| Oligonucleotide name | Overexpressed in cancers | Chip reference |
|---|---|---|
| R35137_0_5_0 (SEQ ID NO:245) | lung malignant tumors | LUN |

Segment cluster R35137_PEA_1_PEA_1_PEA_1_node_20 (SEQ ID NO:862) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5(SEQ ID NO:115), R35137_PEA_1_PEA_1_PEA_1_T10(SEQ ID NO:116), R35137_PEA_1_PEA_1_PEA_1_T11 (SEQ ID NO:117) and R35137_PEA_1_PEA_1_PEA_1_T12 (SEQ ID NO:118). Table 996 below describes the starting and ending position of this segment on each transcript.

TABLE 996

Segment location on transcripts

| Transcript name | Segment starting position | Segment ending position |
|---|---|---|
| R35137_PEA_1_PEA_1_PEA_1_T3 (SEQ ID NO:114) | 1469 | 1624 |
| R35137_PEA_1_PEA_1_PEA_1_T5 (SEQ ID NO:115) | 1402 | 1557 |
| R35137_PEA_1_PEA_1_PEA_1_T10 (SEQ ID NO:116) | 1569 | 1724 |
| R35137_PEA_1_PEA_1_PEA_1_T11 (SEQ ID NO:117) | 1502 | 1657 |
| R35137_PEA_1_PEA_1_PEA_1_T12 (SEQ ID NO:118) | 1569 | 1724 |

Segment cluster R35137_PEA_1_PEA_1_PEA_1_node_27 (SEQ ID NO:863) according to the present invention is supported by 39 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T11 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 997 below describes the starting and ending position of this segment on each transcript.

TABLE 997

Segment location on transcripts

| Transcript name | Segment starting position | Segment ending position |
|---|---|---|
| R35137_PEA_1_PEA_1_PEA_1_T3 (SEQ ID NO:114) | 1876 | 3898 |
| R35137_PEA_1_PEA_1_PEA_1_T5 (SEQ ID NO:115) | 1752 | 3774 |
| R35137_PEA_1_PEA_1_PEA_1_T10 (SEQ ID NO:116) | 1976 | 3998 |
| R35137_PEA_1_PEA_1_PEA_1_T11 (SEQ ID NO:117) | 2049 | 4071 |
| R35137_PEA_1_PEA_1_PEA_1_T12 (SEQ ID NO:118) | 2116 | 4138 |
| R35137_PEA_1_PEA_1_PEA_1_T14 (SEQ ID NO:119) | 1134 | 1250 |

According to an optional embodiment of the present invention, short segments related to the above cluster are also provided. These segments are up to about 120 bp in length, and so are included in a separate description.

Segment cluster R35137_PEA_1_PEA_1_PEA_1_node_5 (SEQ ID NO:864) according to the present invention is supported by 20 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11(SEQ ID NO:117), R35137_PEA_1_PEA_1_PEA_1_T12(SEQ ID NO:118) and R35137_PEA_1_PEA_1_PEA_1_T14 (SEQ ID NO:119). Table 998 below describes the starting and ending position of this segment on each transcript.

TABLE 998

Segment location on transcripts

| Transcript name | Segment starting position | Segment ending position |
|---|---|---|
| R35137_PEA_1_PEA_1_PEA_1_T3 (SEQ ID NO:114) | 433 | 522 |
| R35137_PEA_1_PEA_1_PEA_1_T5 (SEQ ID NO:115) | 433 | 522 |
| R35137_PEA_1_PEA_1_PEA_1_T10 (SEQ ID NO:116) | 433 | 522 |
| R35137_PEA_1_PEA_1_PEA_1_T11 (SEQ ID NO:117) | 433 | 522 |
| R35137_PEA_1_PEA_1_PEA_1_T12 (SEQ ID NO:118) | 433 | 522 |
| R35137_PEA_1_PEA_1_PEA_1_T14 (SEQ ID NO:119) | 433 | 522 |

Segment cluster R35137_PEA_1_PEA_1_PEA_1_node_7 (SEQ ID NO:865) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 999 below describes the starting and ending position of this segment on each transcript.

TABLE 999

Segment location on transcripts

| Transcript name | Segment starting position | Segment ending position |
|---|---|---|
| R35137_PEA_1_PEA_1_PEA_1_T3 (SEQ ID NO:114) | 523 | 631 |
| R35137_PEA_1_PEA_1_PEA_1_T5 (SEQ ID NO:115) | 523 | 631 |
| R35137_PEA_1_PEA_1_PEA_1_T10 (SEQ ID NO:116) | 523 | 631 |
| R35137_PEA_1_PEA_1_PEA_1_T11 (SEQ ID NO:117) | 523 | 631 |
| R35137_PEA_1_PEA_1_PEA_1_T12 (SEQ ID NO:118) | 523 | 631 |
| R35137_PEA_1_PEA_1_PEA_1_T14 (SEQ ID NO:119) | 523 | 631 |

Segment cluster R35137_PEA_1_PEA_1_PEA_1_node_12 (SEQ ID NO:866) according to the present invention is supported by 22 libraries. The number of libraries was determined as previously described. This segment can be found in the following transcript(s): R35137_PEA_

1_PEA_1_PEA_1_T3 (SEQ ID NO:114), R35137_PEA_1_PEA_1_PEA_1_T5 (SEQ ID NO:115), R35137_PEA_1_PEA_1_PEA_1_T 0 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1000 below describes the starting and ending position of this segment on each transcript.

TABLE 1000

Segment location on transcripts

| Transcript name | Segment starting position | Segment ending position |
|---|---|---|
| R35137_PEA_1_PEA_1_PEA_1_T3 (SEQ ID NO:114) | 956 | 1009 |
| R35137_PEA_1_PEA_1_PEA_1_T5 (SEQ ID NO:115) | 956 | 1009 |
| R35137_PEA_1_PEA_1_PEA_1_T10 (SEQ ID NO:116) | 956 | 1009 |
| R35137_PEA_1_PEA_1_PEA_1_T11 (SEQ ID NO:117) | 956 | 1009 |
| R35137_PEA_1_PEA_1_PEA_1_T12 (SEQ ID NO:118) | 956 | 1009 |

Segment cluster R35137_PEA_1_PEA_1_PEA_1_node_14 (SEQ ID NO:867) according to the present invention is supported by 23 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1001 below describes the starting and ending position of this segment on each transcript.

TABLE 1001

Segment location on transcripts

| Transcript name | Segment starting position | Segment ending position |
|---|---|---|
| R35137_PEA_1_PEA_1_PEA_1_T3 (SEQ ID NO:114) | 1010 | 1089 |
| R35137_PEA_1_PEA_1_PEA_1_T5 (SEQ ID NO:115) | 1010 | 1089 |
| R35137_PEA_1_PEA_1_PEA_1_T10 (SEQ ID NO:116) | 1010 | 1089 |
| R35137_PEA_1_PEA_1_PEA_1_T11 (SEQ ID NO:117) | 1010 | 1089 |
| R35137_PEA_1_PEA_1_PEA_1_T12 (SEQ ID NO:118) | 1010 | 1089 |

Segment cluster R35137_PEA_1_PEA_1_PEA_1_node_15 (SEQ ID NO:868) according to the present invention is supported by 6 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T10(SEQ ID NO:116) and R35137_PEA_1_PEA_1_PEA_1_T12 (SEQ ID NO:118). Table 1002 below describes the starting and ending position of this segment on each transcript.

TABLE 1002

Segment location on transcripts

| Transcript name | Segment starting position | Segment ending position |
|---|---|---|
| R35137_PEA_1_PEA_1_PEA_1_T3 (SEQ ID NO:114) | 1090 | 1156 |
| R35137_PEA_1_PEA_1_PEA_1_T10 (SEQ ID NO:116) | 1090 | 1156 |
| R35137_PEA_1_PEA_1_PEA_1_T12 (SEQ ID NO:118) | 1090 | 1156 |

Segment cluster R35137_PEA_1_PEA_1_PEA_1_node_17 (SEQ ID NO:869) according to the present invention is supported by 5 libraries. The number of libraries was determined as previously described. This segment can be found in the following transcript(s): R35137_PEA_1_PEA_1_PEA_1_T10 (SEQ ID NO:116), R35137_PEA_1_PEA_1_PEA_1_T11 (SEQ ID NO:117) and R35137_PEA_1_PEA_1_PEA_1_T12 (SEQ ID NO:118). Table 1003 below describes the starting and ending position of this segment on each transcript.

TABLE 1003

Segment location on transcripts

| Transcript name | Segment starting position | Segment ending position |
|---|---|---|
| R35137_PEA_1_PEA_1_PEA_1_T10 (SEQ ID NO:116) | 1294 | 1393 |
| R35137_PEA_1_PEA_1_PEA_1_T11 (SEQ ID NO:117) | 1227 | 1326 |
| R35137_PEA_1_PEA_1_PEA_1_T12 (SEQ ID NO:118) | 1294 | 1393 |

Segment cluster R35137_PEA_1_PEA_1_PEA_1_node_21 (SEQ ID NO:870) according to the present invention is supported by 6 libraries. The number of libraries was determined as previously described. This segment can be found in the following transcript(s): R35137_PEA_1_PEA_1_PEA_1_T11 (SEQ ID NO:117) and R35137_PEA_1_PEA_1_PEA_1_T12 (SEQ ID NO:118). Table 1004 below describes the starting and ending position of this segment on each transcript.

TABLE 1004

Segment location on transcripts

| Transcript name | Segment starting position | Segment ending position |
|---|---|---|
| R35137_PEA_1_PEA_1_PEA_1_T11 (SEQ ID NO:117) | 1658 | 1731 |
| R35137_PEA_1_PEA_1_PEA_1_T12 (SEQ ID NO:118) | 1725 | 1798 |

Segment cluster R35137_PEA_1_PEA_1_PEA_1_node_22 (SEQ ID NO:871) according to the present invention is supported by 31 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_

1_PEA_1_PEA_1_T11 (SEQ ID NO:117) and R35137_PEA_1_PEA_1_PEA_1_T12 (SEQ ID NO:118). Table 1005 below describes the starting and ending position of this segment on each transcript.

TABLE 1005

Segment location on transcripts

| Transcript name | Segment starting position | Segment ending position |
|---|---|---|
| R35137_PEA_1_PEA_1_PEA_1_T3 (SEQ ID NO:114) | 1625 | 1697 |
| R35137_PEA_1_PEA_1_PEA_1_T5 (SEQ ID NO:115) | 1558 | 1630 |
| R35137_PEA_1_PEA_1_PEA_1_T10 (SEQ ID NO:116) | 1725 | 1797 |
| R35137_PEA_1_PEA_1_PEA_1_T11 (SEQ ID NO:117) | 1732 | 1804 |
| R35137_PEA_1_PEA_1_PEA_1_T12 (SEQ ID NO:118) | 1799 | 1871 |

Segment cluster R35137_PEA_1_PEA_1_PEA_1_node_23 (SEQ ID NO:872) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T1 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1006 below describes the starting and ending position of this segment on each transcript.

TABLE 1006

Segment location on transcripts

| Transcript name | Segment starting position | Segment ending position |
|---|---|---|
| R35137_PEA_1_PEA_1_PEA_1_T3 (SEQ ID NO:114) | 1698 | 1737 |
| R35137_PEA_1_PEA_1_PEA_1_T5 (SEQ ID NO:115) | 1631 | 1670 |
| R35137_PEA_1_PEA_1_PEA_1_T10 (SEQ ID NO:116) | 1798 | 1837 |
| R35137_PEA_1_PEA_1_PEA_1_T11 (SEQ ID NO:117) | 1805 | 1844 |
| R35137_PEA_1_PEA_1_PEA_1_T12 (SEQ ID NO:118) | 1872 | 1911 |
| R35137_PEA_1_PEA_1_PEA_1_T14 (SEQ ID NO:119) | 956 | 995 |

Segment cluster R35137_PEA_1_PEA_1_PEA_1_node_24 (SEQ ID NO:873) according to the present invention is supported by 5 libraries. The number of libraries was determined as previously described. This segment can be found in the following transcript(s): R35137_PEA_1_PEA_1_PEA_1_T11 (SEQ ID NO:117) and R35137_PEA_1_PEA_1_PEA_1_T12 (SEQ ID NO:118). Table 1007 below describes the starting and ending position of this segment on each transcript.

TABLE 1007

Segment location on transcripts

| Transcript name | Segment starting position | Segment ending position |
|---|---|---|
| R35137_PEA_1_PEA_1_PEA_1_T11 (SEQ ID NO:117) | 1845 | 1910 |
| R35137_PEA_1_PEA_1_PEA_1_T12 (SEQ ID NO:118) | 1912 | 1977 |

Segment cluster R35137_PEA_1_PEA_1_PEA_1_node_25 (SEQ ID NO:874) according to the present invention is supported by 30 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T5 (SEQ ID NO:115), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1008 below describes the starting and ending position of this segment on each transcript.

TABLE 1008

Segment location on transcripts

| Transcript name | Segment starting position | Segment ending position |
|---|---|---|
| R35137_PEA_1_PEA_1_PEA_1_T3 (SEQ ID NO:114) | 1738 | 1818 |
| R35137_PEA_1_PEA_1_PEA_1_T5 (SEQ ID NO:115) | 1671 | 1751 |
| R35137_PEA_1_PEA_1_PEA_1_T10 (SEQ ID NO:116) | 1838 | 1918 |
| R35137_PEA_1_PEA_1_PEA_1_T11 (SEQ ID NO:117) | 1911 | 1991 |
| R35137_PEA_1_PEA_1_PEA_1_T12 (SEQ ID NO:118) | 1978 | 2058 |
| R35137_PEA_1_PEA_1_PEA_1_T14 (SEQ ID NO:119) | 996 | 1076 |

Segment cluster R35137_PEA_1_PEA_1_PEA_1_node_26 (SEQ ID NO:875) according to the present invention is supported by 29 libraries. The number of libraries was determined as previously described. This segment can be found in the following transcript(s): R35137_PEA_1_PEA_1_PEA_1_T3 (SEQ ID NO:114), R35137_PEA_1_PEA_1_PEA_1_T10 (SEQ ID NO:116), R35137_PEA_1_PEA_1_PEA_1_T11 (SEQ ID NO:117), R35137_PEA_1_PEA_1_PEA_1_T12 (SEQ ID NO:118) and R35137_PEA_1_PEA_1_PEA_1_T14 (SEQ ID NO:119). Table 1009 below describes the starting and ending position of this segment on each transcript.

TABLE 1009

Segment location on transcripts

| Transcript name | Segment starting position | Segment ending position |
|---|---|---|
| R35137_PEA_1_PEA_1_PEA_1_T3 (SEQ ID NO:114) | 1819 | 1875 |

TABLE 1009-continued

Segment location on transcripts

| Transcript name | Segment starting position | Segment ending position |
|---|---|---|
| R35137_PEA_1_PEA_1_PEA_1_T10 (SEQ ID NO:116) | 1919 | 1975 |
| R35137_PEA_1_PEA_1_PEA_1_T11 (SEQ ID NO:117) | 1992 | 2048 |
| R35137_PEA_1_PEA_1_PEA_1_T12 (SEQ ID NO:118) | 2059 | 2115 |
| R35137_PEA_1_PEA_1_PEA_1_T14 (SEQ ID NO:119) | 1077 | 1133 |

Variant protein alignment to the previously known protein:

Sequence name: ALAT_HUMAN_V1 (SEQ ID NO:1453)

Sequence documentation:

Alignment of: R35137_PEA_1_PEA_1_PEA_1_P9 (SEQ ID NO:1385) x ALAT_HUMAN_V1 (SEQ ID NO:1453) . . .

Alignment segment 1/1:

| Quality: | 2619.00 | Escore: | 0 |
|---|---|---|---|
| Matching length: | 274 | Total length: | 274 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||| 
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    ||||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    ||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    ||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    ||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEV                           274
    ||||||||||||||||||||||||
251 TRECIEAVIRFAFEERLFLLADEV                           274
```

Sequence name: ALAT_HUMAN_V1 (SEQ ID NO:1453)

Sequence documentation:

Alignment of: R35137_PEA_1_PEA_1_PEA_1_P8 (SEQ ID NO:1386) x ALAT_HUMAN_V1 (SEQ ID NO:1453) . . .

Alignment segment 1/1:

| Quality: | 3088.00 | Escore: | 0 |
|---|---|---|---|
| Matching length: | 320 | Total length: | 320 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    |||||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    |||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    |||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    |||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEVYQDNVYAAGSQFHSFKKVLMEMGPPY 300
    |||||||||||||||||||||||||||||||||||||||||||||||||||
251 TRECIEAVIRFAFEERLFLLADEVYQDNVYAAGSQFHSFKKVLMEMGPPY 300

301 AGQQELASFHSTSKGYMGEC                               320
    ||||||||||||||||||||
301 AGQQELASFHSTSKGYMGEC                               320
```

Sequence name: ALAT_HUMAN_V1 (SEQ ID NO:1453)

Sequence documentation:

Alignment of: R35137_PEA_1_PEA_1_PEA_1_P11 (SEQ ID NO:1387) x ALAT_HUMAN_V1 (SEQ ID NO:1453) . . .

Alignment segment 1/1:

| | | | |
|---|---|---|---|
| Quality: | 2487.00 | Escore: | 0 |
| Matching length: | 271 | Total length: | 496 |
| Matching Percent Similarity: | 100.00 | Matching Percent Identity: | 100.00 |
| Total Percent Similarity: | 54.64 | Total Percent Identity: | 54.64 |
| Gaps: | 1 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    |||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    |||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    |||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQAR..................... 229
    ||||||||||||||||||||||||||||
201 AVQVDYYLDEERAWALDVAELHRALGQARDHCRPRALCVINPGNPTGQVQ 250

229 ................................................. 229

251 TRECIEAVIRFAFEERLFLLADEVYQDNVYAAGSQFHSFKKVLMEMGPPY 300

229 ................................................. 229

301 AGQQELASFHSTSKGYMGECGFRGGYVEVVNMDAAVQQQMLKLMSVRLCP 350

229 ................................................. 229

351 PVPGQALLDLVVSPPAPTDPSFAQFQAEKQAVLAELAAKAKLTEQVFNEA 400

229 ................................................. 229

401 PGISCNPVQGAMYSFPRVQLPPRAVERAQELGLAPDMFFCLRLLEETGIC 450

230 ....SGFGQREGTYHFRMTILPPLEKLRLLLEKLSRFHAKFTLEYS     271
        |||||||||||||||||||||||||||||||||||||||||||
451 VVPGSGFGQREGTYHFRMTILPPLEKLRLLLEKLSRFHAKFTLEYS     496
```

Sequence name: ALAT_HUMAN_V1 (SEQ ID NO:1453)

Sequence documentation:

Alignment of: R35137_PEA_1_PEA_1_PEA_1_P2 (SEQ ID NO:1388) x ALAT_HUMAN_V1 (SEQ ID NO:1453) . . .

Alignment segment 1/1:

| | | | |
|---|---|---|---|
| Quality: | 2619.00 | Escore: | 0 |
| Matching length: | 274 | Total length: | 274 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    |||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    |||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    |||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    |||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEV                          274
    ||||||||||||||||||||||||
251 TRECIEAVIRFAFEERLFLLADEV                          274
```

Sequence name: ALAT_HUMAN_V1 (SEQ ID NO:1453)

Sequence documentation:

Alignment of: R35137_PEA_1_PEA_1_PEA_1_P4 (SEQ ID NO:1389) x ALAT_HUMAN_V1 (SEQ ID NO:1453) . . .

Alignment segment 1/1:

| | | | |
|---|---|---|---|
| Quality: | 4785.00 | Escore: | 0 |
| Matching length: | 494 | Total length: | 494 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MASSTGDRSQAVRHGLRAKVLTLDGMNPRVRRVEYAVRGPIVQRALELEQ  50
    |||||||||||||||||||||||||||||||||||||||||||||||||||
  1 MASSTGDRSQAVRHGLRAKVLTLDGMNPRVRRVEYAVRGPIVQRALELEQ  50

51 ELRQGVKKPFTEVIRANIGDAQAMGQRPITFLRQVLALCVNPDLLSSPNF 100
    |||||||||||||||||||||||||||||||||||||||||||||||||||
 51 ELRQGVKKPFTEVIRANIGDAQAMGQRPITFLRQVLALCVNPDLLSSPNF 100

101 PDDAKKRAERILQACGGHSLGAYSVSSGIQLIREDVARYIERRDGGIPAD 150
    |||||||||||||||||||||||||||||||||||||||||||||||||||
101 PDDAKKRAERILQACGGHSLGAYSVSSGIQLIREDVARYIERRDGGIPAD 150

151 PNNVFLSTGASDAIVTVLKLLVAGEGHTRTGVLIPIPQYPLYSATLAELG 200
    |||||||||||||||||||||||||||||||||||||||||||||||||||
151 PNNVFLSTGASDAIVTVLKLLVAGEGHTRTGVLIPIPQYPLYSATLAELG 200

201 AVQVDYYLDEERAWALDVAELHRALGQARDHCRPRALCVINPGNPTGQVQ 250
    |||||||||||||||||||||||||||||||||||||||||||||||||||
201 AVQVDYYLDEERAWALDVAELHRALGQARDHCRPRALCVINPGNPTGQVQ 250

251 TRECIEAVIRFAFEERLFLLADEVYQDNVYAAGSQFHSFKKVLMEMGPPY 300
    |||||||||||||||||||||||||||||||||||||||||||||||||||
251 TRECIEAVIRFAFEERLFLLADEVYQDNVYAAGSQFHSFKKVLMEMGPPY 300

301 AGQQELASFHSTSKGYMGECGFRGGYVEVVNMDAAVQQQMLKLMSVRLCP 350
    |||||||||||||||||||||||||||||||||||||||||||||||||||
301 AGQQELASFHSTSKGYMGECGFRGGYVEVVNMDAAVQQQMLKLMSVRLCP 350

351 PVPGQALLDLVVSPPAPTDPSFAQFQAEKQAVLAELAAKAKLTEQVFNEA 400
    |||||||||||||||||||||||||||||||||||||||||||||||||||
351 PVPGQALLDLVVSPPAPTDPSFAQFQAEKQAVLAELAAKAKLTEQVFNEA 400

401 PGISCNPVQGAMYSFPRVQLPPRAVERAQELGLAPDMFFCLRLLEETGIC 450
    |||||||||||||||||||||||||||||||||||||||||||||||||||
401 PGISCNPVQGAMYSFPRVQLPPRAVERAQELGLAPDMFFCLRLLEETGIC 450

451 VVPGSGFGQREGTYHFRMTILPPLEKLRLLLEKLSRFHAKFTLE        494
    |||||||||||||||||||||||||||||||||||||||||||
451 VVPGSGFGQREGTYHFRMTILPPLEKLRLLLEKLSRFHAKFTLE        494
```

Description for Cluster Z25299

Cluster Z25299 features 5 transcript(s) and 11 segment(s) of interest, the names for which are given in Tables 1010 and 1011, respectively, the sequences themselves are given at the end of the application. The selected protein variants are given in table 1012.

TABLE 1010

Transcripts of interest

| Transcript Name | Sequence ID No. |
|---|---|
| Z25299_PEA_2_T1 | 120 |
| Z25299_PEA_2_T2 | 121 |
| Z25299_PEA_2_T3 | 122 |
| Z25299_PEA_2_T6 | 123 |
| Z25299_PEA_2_T9 | 124 |

TABLE 1011

Segments of interest

| Segment Name | Sequence ID No. |
|---|---|
| Z25299_PEA_2_node_20 | 876 |
| Z25299_PEA_2_node_21 | 877 |
| Z25299_PEA_2_node_23 | 878 |
| Z25299_PEA_2_node_24 | 879 |
| Z25299_PEA_2_node_8 | 880 |
| Z25299_PEA_2_node_12 | 881 |
| Z25299_PEA_2_node_13 | 882 |
| Z25299_PEA_2_node_14 | 883 |
| Z25299_PEA_2_node_17 | 884 |
| Z25299_PEA_2_node_18 | 885 |
| Z25299_PEA_2_node_19 | 886 |

TABLE 1012

Proteins of interest

| Protein Name | Sequence ID No. |
|---|---|
| Z25299_PEA_2_P2 | 1390 |
| Z25299_PEA_2_P3 | 1391 |
| Z25299_PEA_2_P7 | 1392 |
| Z25299_PEA_2_P10 | 1393 |

These sequences are variants of the known protein Antileukoproteinase 1 precursor (SwissProt accession identifier ALK1_HUMAN; known also according to the synonyms ALP; HUSI-1; Seminal proteinase inhibitor; Secretory leukocyte protease inhibitor; BLPI; Mucus proteinase inhibitor; MPI; WAP four-disulfide core domain protein 4; Protease inhibitor WAP4), SEQ ID NO:1454, referred to herein as the previously known protein.

Protein Antileukoproteinase 1 precursor (SEQ ID NO:1454) is known or believed to have the following function(s): Acid-stable proteinase inhibitor with strong affinities for trypsin, chymotrypsin, elastase, and cathepsin G. May prevent elastase-mediated damage to oral and possibly other mucosal tissues. The sequence for protein Antileukoproteinase 1 precursor is given at the end of the application, as "Antileukoproteinase 1 precursor amino acid sequence". Protein Antileukoproteinase 1 precursor localization is believed to be Secreted.

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Elastase inhibitor; Tryptase inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anti-inflammatory; Antiasthma.

The following GO Annotation(s) apply to the previously known protein. The following annotation(s) were found: proteinase inhibitor; serine protease inhibitor, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster Z25299 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 35 refer to weighted expression of ESTs in each category, as "parts per million" (ratio of the expression of ESTs for a particular cluster to the expression of all ESTs in that category, according to parts per million).

Figure 35:
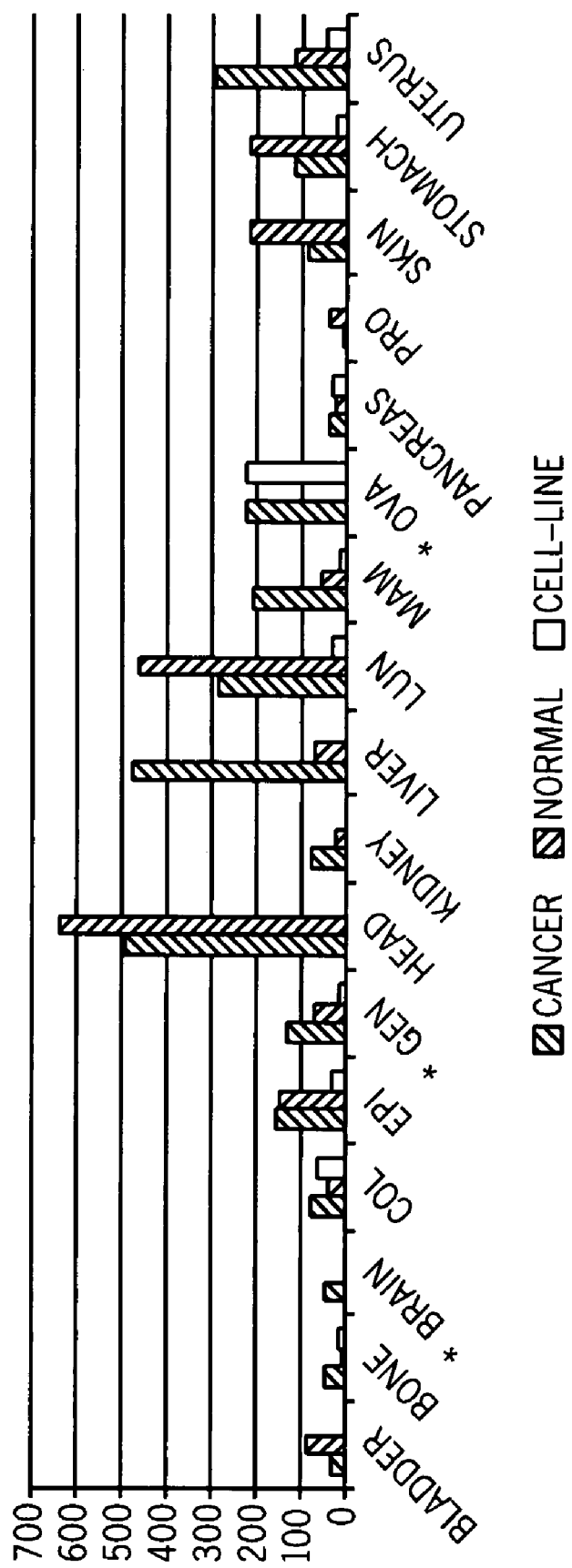
FIG. 35 is a histogram showing Cancer and cell-line vs. normal tissue expression for Cluster Z25299, demonstrating overexpression in brain malignant tumors, a mixture of malignant tumors from different tissues and ovarian carcinoma.

Overall, the following results were obtained as shown with regard to the histograms in FIG. 35 and Table 1013. This cluster is overexpressed (at least at a minimum level) in the following pathological conditions: brain malignant tumors, a mixture of malignant tumors from different tissues and ovarian carcinoma.

TABLE 1013

Normal tissue distribution

| Name of Tissue | Number |
|---|---|
| bladder | 82 |
| bone | 6 |
| brain | 0 |
| colon | 37 |
| epithelial | 145 |
| general | 73 |

TABLE 1013-continued

Normal tissue distribution

| Name of Tissue | Number |
|---|---|
| head and neck | 638 |
| kidney | 26 |
| liver | 68 |
| lung | 465 |
| breast | 52 |
| ovary | 0 |
| pancreas | 20 |
| prostate | 36 |
| skin | 215 |
| stomach | 219 |
| uterus | 113 |

TABLE 1014

P values and ratios for expression in cancerous tissue

| Name of Tissue | P1 | P2 | SP1 | R3 | SP2 | R4 |
|---|---|---|---|---|---|---|
| bladder | 8.2e−01 | 8.5e−01 | 9.2e−01 | 0.6 | 9.7e−01 | 0.5 |
| bone | 5.5e−01 | 7.3e−01 | 4.0e−01 | 2.1 | 4.9e−01 | 1.5 |
| brain | 8.8e−02 | 1.5e−01 | 2.3e−03 | 7.7 | 1.2e−02 | 4.8 |
| colon | 3.3e−01 | 2.8e−01 | 4.2e−01 | 1 6 | 4.2e−01 | 1.5 |
| epithelial | 2.5e−01 | 7.6e−01 | 3.8e−01 | 1.0 | 1 | 0.6 |
| general | 6.4e−03 | 2.5e−01 | 1.7e−06 | 1.6 | 5.2e−01 | 0.9 |
| head and neck | 3.6e−01 | 5.9e−01 | 7.6e−01 | 0.6 | 1 | 0.3 |
| kidney | 7.4e−01 | 8.4e−01 | 2.1e−01 | 2.1 | 4.2e−01 | 1.4 |
| liver | 4.1e−01 | 9.1e−01 | 4.2e−02 | 3.2 | 6.4e−01 | 0.8 |
| lung | 7.6e−01 | 8.3e−01 | 9.8e−01 | 0.5 | 1 | 0.3 |
| breast | 5.0e−01 | 5.5e−01 | 9.8e−02 | 1.6 | 3.4e−01 | 1.1 |
| ovary | 3.7e−02 | 3.0e−02 | 6.9e−03 | 6.1 | 4.9e−03 | 5.6 |
| pancreas | 3.8e−01 | 3.6e−01 | 3.6e−01 | 1.7 | 3.9e−01 | 1.5 |
| prostate | 9.1e−01 | 9.2e−01 | 8.9e−01 | 0.5 | 9.4e−01 | 0.5 |
| skin | 6.0e−01 | 8.1e−01 | 9.3e−01 | 0.4 | 1 | 0.1 |
| stomach | 3.0e−01 | 8.1e−01 | 9.1e−01 | 0.6 | 1 | 0.3 |
| uterus | 1.6e−01 | 1.3e−01 | 3.2e−02 | 1.6 | 3.0e−01 | 1.1 |

As noted above, cluster Z25299 features 5 transcript(s), which were listed in Table 1010 above. These transcript(s) encode for protein(s) which are variant(s) of protein Antileukoproteinase 1 precursor (SEQ ID NO:1454). A description of each variant protein according to the present invention is now provided.

Variant protein Z25299_PEA_2_P2 (SEQ ID NO:1390) according to the present invention has an amino acid sequence as given at the end of the application; it is encoded by transcript(s) Z25299_PEA_2_T1 (SEQ ID NO:120). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison report between Z25299_PEA_2_P2 (SEQ ID NO:1390) and ALK1_HUMAN (SEQ ID NO:1454):

1. An isolated chimeric polypeptide encoding for Z25299_PEA_2_P2 (SEQ ID NO:1390), comprising a first amino acid sequence being at least 90% homologous to MKSSGLFPFLVLLALGTLAPWAVEGS-GKSFKAGVCPPKKSAQCLRYKKPECQSD-WQCPGKKRCCPDTCGI KCLDPVDTPNPTRRK-PGKCPVTYGQCLMLNPPNFCEMDGQCKRDLKCCM-GMCGKSCVSPVK corresponding to amino acids 1-131 of ALK1_HUMAN (SEQ ID NO:1454), which also corresponds to amino acids 1-131 of Z25299_PEA_2_P2 (SEQ ID NO:1390), and a second amino acid sequence being at least 70%, optionally at least 80%, preferably at least 85%, more preferably at least 90% and most preferably at least 95% homologous to a polypeptide having the sequence GKQGMRAH (SEQ ID NO: 279) corresponding to amino acids 132-139 of Z25299_PEA_2_P2 (SEQ ID NO:1390), wherein said first and second amino acid sequences are contiguous and in a sequential order.

2. An isolated polypeptide encoding for a tail of Z25299_PEA_2_P2 (SEQ ID NO:1390), comprising a polypeptide being at least 70%, optionally at least about 80%, preferably at least about 85%, more preferably at least about 90% and most preferably at least about 95% homologous to the sequence GKQGMRAH (SEQ ID NO: 279) in Z25299_PEA_2_P2 (SEQ ID NO:1390).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P2 (SEQ ID NO:1390) also has the following non-silent SNPs (Single Nucleotide Polymorphisms) as listed in Table 1015, (given according to their position(s) on the amino acid sequence, with the alternative amino acid(s) listed; the last column indicates whether the SNP is known or not; the presence of known SNPs in variant protein Z25299_PEA_2_P2 (SEQ ID NO:1390) sequence provides support for the deduced sequence of this variant protein according to the present invention).

TABLE 1015

Amino acid mutations

| SNP position(s) on amino acid sequence | Alternative amino acid(s) | Previously known SNP? |
|---|---|---|
| 136 | M -> T | Yes |
| 20 | P -> | No |
| 43 | C -> R | No |
| 48 | K -> N | No |
| 83 | R -> K | No |
| 84 | R -> W | No |

Variant protein Z25299_PEA_2_P2 (SEQ ID NO:1390) is encoded by the following transcript(s): Z25299_PEA_2_T1 (SEQ ID NO:120), for which the sequence(s) is/are given at the end of the application. The coding portion of transcript Z25299_PEA_2_T1 (SEQ ID NO:120) is shown in bold; this coding portion starts at position 124 and ends at position 540. The transcript also has the following SNPs as listed in Table 1016 (given according to their position on the nucleotide sequence, with the alternative nucleic acid listed; the last column indicates whether the SNP is known or not; the presence of known SNPs in variant protein Z25299_PEA_2_P2 (SEQ ID NO:1390) sequence provides support for the deduced sequence of this variant protein according to the present invention).

TABLE 1016

Nucleic acid SNPs

| SNP position on nucleotide sequence | Alternative nucleic acid | Previously known SNP? |
|---|---|---|
| 122 | C -> T | No |
| 123 | C -> T | No |
| 530 | T -> C | Yes |
| 989 | C -> T | Yes |
| 1127 | C -> T | Yes |
| 1162 | A -> C | Yes |
| 1180 | A -> C | Yes |
| 1183 | A -> C | Yes |
| 1216 | A -> C | Yes |
| 1262 | G -> A | Yes |
| 183 | T -> | No |
| 250 | T -> C | No |
| 267 | A -> C | No |
| 267 | A -> G | No |
| 339 | C -> T | Yes |
| 371 | G -> A | No |
| 373 | A -> T | No |
| 435 | C -> T | No |

Variant protein Z25299_PEA_2_P3 (SEQ ID NO:1391) according to the present invention has an amino acid sequence as given at the end of the application; it is encoded by transcript(s) Z25299_PEA_2_T2 (SEQ ID NO:121). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison report between Z25299_PEA_2_P3 (SEQ ID NO:1391) and ALK1_HUMAN (SEQ ID NO:1454):

1. An isolated chimeric polypeptide encoding for Z25299_PEA_2_P3 (SEQ ID NO:1391), comprising a first amino acid sequence being at least 90% homologous to MKSSGLFPFLVLLALGTLAPWAVEGSGKSFKAGV-CPPKKSAQCLRYKKPECQSDWQCPGKKRCCPDTCGI KCLDPVDTPNPTRRKPGKCPVTYGQCLMLNPPNFC-EMDGQCKRDLKCCMGMCGKSCVSPVK corresponding to amino acids 1-131 of ALK1_HUMAN (SEQ ID NO:1454), which also corresponds to amino acids 1-131 of Z25299_PEA_2_P3 (SEQ ID NO:1391), and a second amino acid sequence being at least 70%, optionally at least 80%, preferably at least 85%, more preferably at least 90% and most preferably at least 95% homologous to a polypeptide having the sequence GEKRHHKQLRDQEVDPLEM-RRHSAG (SEQ ID NO: 269) corresponding to amino acids 132-156 of Z25299_PEA_2_P3 (SEQ ID NO:1391), wherein said first and second amino acid sequences are contiguous and in a sequential order.

2. An isolated polypeptide encoding for a tail of Z25299_PEA_2_P3 (SEQ ID NO:1391), comprising a polypeptide being at least 70%, optionally at least about 80%, preferably at least about 85%, more preferably at least about 90% and most preferably at least about 95% homologous to the sequence GEKRHHKQLRDQEVDPLEMRRHSAG (SEQ ID NO: 269) in Z25299_PEA_2_P3 (SEQ ID NO:1391).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P3 (SEQ ID NO:1391) also has the following non-silent SNPs (Single Nucleotide Polymorphisms) as listed in Table 1017, (given according to their position(s) on the amino acid sequence, with the alternative amino acid(s) listed; the last column indicates whether the SNP is known or not; the presence of known SNPs in variant protein Z25299_PEA_2_P3 (SEQ ID NO:1391) sequence provides support for the deduced sequence of this variant protein according to the present invention).

TABLE 1017

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |
| 83 | R -> K | No |
| 84 | R -> W | No |

Variant protein Z25299_PEA_2_P3 (SEQ ID NO:1391) is encoded by the following transcript(s): Z25299_PEA_2_T2 (SEQ ID NO:121), for which the sequence(s) is/are given at the end of the application. The coding portion of transcript Z25299_PEA_2_T2 (SEQ ID NO:121) is shown in bold; this coding portion starts at position 124 and ends at position 591. The transcript also has the following SNPs as listed in Table 1018 (given according to their position on the nucleotide sequence, with the alternative nucleic acid listed; the last column indicates whether the SNP is known or not; the presence of known SNPs in variant protein Z25299_PEA_2_P3 (SEQ ID NO:1391) sequence provides support for the deduced sequence of this variant protein according to the present invention).

TABLE 1018

Nucleic acid SNPs

| SNP position on nucleotide sequence | Alternative nucleic acid | Previously known SNP? |
|---|---|---|
| 122 | C -> T | No |
| 123 | C -> T | No |
| 183 | T -> | No |
| 250 | T -> C | No |
| 267 | A -> C | No |
| 267 | A -> G | No |
| 339 | C -> T | Yes |
| 371 | G -> A | No |
| 373 | A -> T | No |
| 435 | C -> T | No |

Variant protein Z25299_PEA_2_P7 (SEQ ID NO:1392) according to the present invention has an amino acid sequence as given at the end of the application; it is encoded by transcript(s) Z25299_PEA_2_T6 (SEQ ID NO:123). An alignment is given to the known protein (Antileukoproteinase 1 precursor (SEQ ID NO:1454).) at the end of the application. One or more alignments to one or more previously published protein sequences are given at the end of the application. A brief description of the relationship of the variant protein according to the present invention to each such aligned protein is as follows:

Comparison report between Z25299_PEA_2_P7 (SEQ ID NO:1392) and ALK1_HUMAN (SEQ ID NO:1454):

1. An isolated chimeric polypeptide encoding for Z25299_PEA_2_P7 (SEQ ID NO:1392), comprising a first amino acid sequence being at least 90% homologous to MKSSGLFPFLVLLALGTLAPWAVEGS-GKSFKAGVCPPKKSAQCLRYKKPECQSD-WQCPGKKRCCPDTCGI KCLDPVDTPNP corresponding to amino acids 1-81 of ALK1_HUMAN (SEQ ID NO:1454), which also corresponds to amino acids 1-81 of Z25299_PEA_2_P7 (SEQ ID NO:1392), and a second amino acid sequence being at least 70%, optionally at least 80%, preferably at least 85%, more preferably at least 90% and most preferably at least 95% homologous to a polypeptide having the sequence RGSLGSAQ (SEQ ID NO: 622) corresponding to amino acids 82-89 of Z25299_PEA_2_P7 (SEQ ID NO:1392), wherein said first and second amino acid sequences are contiguous and in a sequential order.

2. An isolated polypeptide encoding for a tail of Z25299_PEA_2_P7 (SEQ ID NO:1392), comprising a polypeptide being at least 70%, optionally at least about 80%, preferably at least about 85%, more preferably at least about 90% and most preferably at least about 95% homologous to the sequence RGSLGSAQ (SEQ ID NO: 622) in Z25299_PEA_2_P7 (SEQ ID NO:1392).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P7 (SEQ ID NO:1392) also has the following non-silent SNPs (Single Nucleotide Polymorphisms) as listed in Table 1019, (given according to their position(s) on the amino acid sequence, with the alternative amino acid(s) listed; the last column indicates whether the SNP is known or not; the presence of known SNPs in variant protein Z25299_PEA_2_P7 (SEQ ID NO:1392) sequence provides support for the deduced sequence of this variant protein according to the present invention).

TABLE 1019

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |
| 82 | R -> S | No |

Variant protein Z25299_PEA_2_P7 (SEQ ID NO:1392) is encoded by the following transcript(s): Z25299_PEA_2_T6 (SEQ ID NO:123), for which the sequence(s) is/are given at the end of the application. The coding portion of transcript Z25299_PEA_2_T6 (SEQ ID NO:123) is shown in bold; this coding portion starts at position 124 and ends at position 390. The transcript also has the following SNPs as listed in Table 1020 (given according to their position on the nucleotide sequence, with the alternative nucleic acid listed; the last column indicates whether the SNP is known or not; the presence of known SNPs in variant protein Z25299_PEA_2_P7 (SEQ ID NO:1392) sequence provides support for the deduced sequence of this variant protein according to the present invention).

TABLE 1020

Nucleic acid SNPs

| SNP position on nucleotide sequence | Alternative nucleic acid | Previously known SNP? |
|---|---|---|
| 122 | C -> T | No |
| 123 | C -> T | No |
| 576 | A -> C | Yes |
| 594 | A -> C | Yes |
| 597 | A -> C | Yes |
| 630 | A -> C | Yes |
| 676 | G -> A | Yes |
| 183 | T -> | No |
| 250 | T -> C | No |
| 267 | A -> C | No |
| 267 | A -> G | No |
| 339 | C -> T | Yes |
| 369 | A -> T | No |
| 431 | C -> T | No |
| 541 | C -> T | Yes |

Variant protein Z25299_PEA_2_P10(SEQ ID NO:1393) according to the present invention has an amino acid sequence as given at the end of the application; it is encoded by transcript(s) Z25299_PEA_2_T9 (SEQ ID NO:124). An alignment is given to the known protein (Antileukoproteinase 1 precursor (SEQ ID NO:1454)) at the end of the application. One or more alignments to one or more previously published protein sequences are given at the end of the application. A brief description of the relationship of the variant protein according to the present invention to each such aligned protein is as follows:

Comparison report between Z25299_PEA_2 P110 (SEQ ID NO:1393) and ALK1_HUMAN (SEQ ID NO:1454):

1. An isolated chimeric polypeptide encoding for Z25299_PEA_2_P10 (SEQ ID NO:1393), comprising a first amino acid sequence being at least 90% homologous to MKSSGLFPFLVLLALGTLAPWAVEGS-GKSFKAGVCPPKKSAQCLRYKKPECQSD-WQCPGKKRCCPDTCGI KCLDPVDTPNPT corresponding to amino acids 1-82 of ALK1_HUMAN (SEQ ID NO:1454), which also corresponds to amino acids 1-82 of Z25299_PEA_2_P10 (SEQ ID NO:1393).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein Z25299_PEA_2_P10 (SEQ ID NO:1393) also has the following non-silent SNPs (Single Nucleotide Polymorphisms) as listed in Table 1021, (given according to their position(s) on the amino acid sequence, with the alternative amino acid(s) listed; the last column indicates whether the SNP is known or not; the presence of known SNPs in variant protein Z25299_PEA_2_P10 (SEQ ID NO:1393) sequence provides support for the deduced sequence of this variant protein according to the present invention).

TABLE 1021

Amino acid mutations

| SNP position(s) on amino acid sequence | Alternative amino acid(s) | Previously known SNP? |
|---|---|---|
| 20 | P -> | No |
| 43 | C -> R | No |
| 48 | K -> N | No |

Variant protein Z25299_PEA_2_P10 (SEQ ID NO:1393) is encoded by the following transcript(s): Z25299_PEA_2_T9 (SEQ ID NO:124), for which the sequence(s) is/are given at the end of the application. The coding portion of transcript Z25299_PEA_2_T9 (SEQ ID NO:124) is shown in bold; this coding portion starts at position 124 and ends at position 369. The transcript also has the following SNPs as listed in Table 1022 (given according to their position on the nucleotide sequence, with the alternative nucleic acid listed; the last column indicates whether the SNP is known or not; the presence of known SNPs in variant protein Z25299_PEA_2_P10 (SEQ ID NO:1393) sequence provides support for the deduced sequence of this variant protein according to the present invention).

TABLE 1022

Nucleic acid SNPs

| SNP position on nucleotide sequence | Alternative nucleic acid | Previously known SNP? |
|---|---|---|
| 122 | C -> T | No |
| 123 | C -> T | No |
| 451 | A -> C | Yes |
| 484 | A -> C | Yes |
| 530 | G -> A | Yes |
| 183 | T -> | No |
| 250 | T -> C | No |
| 267 | A -> C | No |
| 267 | A -> G | No |
| 339 | C -> T | Yes |
| 395 | C -> T | Yes |
| 430 | A -> C | Yes |
| 448 | A -> C | Yes |

As noted above, cluster Z25299 features 11 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z25299_PEA_2_node_20 (SEQ ID NO:876) according to the present invention is supported by 6 libraries. The number of libraries was determined as previously described. This segment can be found in the following transcript(s): Z25299_PEA_2_T1 (SEQ ID NO:120). Table 1023 below describes the starting and ending position of this segment on each transcript.

TABLE 1023

Segment location on transcripts

| Transcript name | Segment starting position | Segment ending position |
|---|---|---|
| Z25299_PEA_2_T1 (SEQ ID NO:120) | 518 | 1099 |

Segment cluster Z25299_PEA_2_node_21 (SEQ ID NO:877) according to the present invention is supported by 162 libraries. The number of libraries was determined as previously described. This segment can be found in the following transcript(s): Z25299_PEA_2_T1 (SEQ ID NO:120), Z25299_PEA_2_T6 (SEQ ID NO:123) and Z25299_PEA_2_T9 (SEQ ID NO:124). Table 1024 below describes the starting and ending position of this segment on each transcript.

TABLE 1024

Segment location on transcripts

| Transcript name | Segment starting position | Segment ending position |
|---|---|---|
| Z25299_PEA_2_T1 (SEQ ID NO:120) | 1100 | 1292 |
| Z25299_PEA_2_T6 (SEQ ID NO:123) | 514 | 706 |
| Z25299_PEA_2_T9 (SEQ ID NO:124) | 368 | 560 |

Segment cluster Z25299_PEA_2_node_23 (SEQ ID NO:878) according to the present invention is supported by 2 libraries. The number of libraries was determined as previously described. This segment can be found in the following transcript(s): Z25299_PEA_2_T2 (SEQ ID NO:121). Table 1025 below describes the starting and ending position of this segment on each transcript.

TABLE 1025

Segment location on transcripts

| Transcript name | Segment starting position | Segment ending position |
|---|---|---|
| Z25299_PEA_2_T2 (SEQ ID NO:121) | 518 | 707 |

Segment cluster Z25299_PEA_2_node_24 (SEQ ID NO:879) according to the present invention is supported by 2 libraries. The number of libraries was determined as previously described. This segment can be found in the following transcript(s): Z25299_PEA_2_T2 (SEQ ID NO:121) and Z25299_PEA_2_T3 (SEQ ID NO:122). Table 1026 below describes the starting and ending position of this segment on each transcript.

TABLE 1026

Segment location on transcripts

| Transcript name | Segment starting position | Segment ending position |
|---|---|---|
| Z25299_PEA_2_T2 (SEQ ID NO:121) | 708 | 886 |
| Z25299_PEA_2_T3 (SEQ ID NO:122) | 518 | 696 |

Segment cluster Z25299_PEA_2_node_8 (SEQ ID NO:880) according to the present invention is supported by 218 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1027 below describes the starting and ending position of this segment on each transcript.

TABLE 1027

Segment location on transcripts

| Transcript name | Segment starting position | Segment ending position |
|---|---|---|
| Z25299_PEA_2_T1 (SEQ ID NO:120) | 1 | 208 |
| Z25299_PEA_2_T2 (SEQ ID NO:121) | 1 | 208 |
| Z25299_PEA_2_T3 (SEQ ID NO:122) | 1 | 208 |
| Z25299_PEA_2_T6 (SEQ ID NO:123) | 1 | 208 |
| Z25299_PEA_2_T9 (SEQ ID NO:124) | 1 | 208 |

According to an optional embodiment of the present invention, short segments related to the above cluster are also provided. These segments are up to about 120 bp in length, and so are included in a separate description.

Segment cluster Z25299_PEA_2_node_12 (SEQ ID NO:881) according to the present invention is supported by 228 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1028 below describes the starting and ending position of this segment on each transcript.

TABLE 1028

Segment location on transcripts

| Transcript name | Segment starting position | Segment ending position |
|---|---|---|
| Z25299_PEA_2_T1 (SEQ ID NO:120) | 209 | 245 |
| Z25299_PEA_2_T2 (SEQ ID NO:121) | 209 | 245 |
| Z25299_PEA_2_T3 (SEQ ID NO:122) | 209 | 245 |
| Z25299_PEA_2_T6 (SEQ ID NO:123) | 209 | 245 |
| Z25299_PEA_2_T9 (SEQ ID NO:124) | 209 | 245 |

Segment cluster Z25299_PEA_2_node_13 (SEQ ID NO:882) according to the present invention is supported by 246 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1029 below describes the starting and ending position of this segment on each transcript.

TABLE 1029

Segment location on transcripts

| Transcript name | Segment starting position | Segment ending position |
| --- | --- | --- |
| Z25299_PEA_2_T1 (SEQ ID NO:120) | 246 | 357 |
| Z25299_PEA_2_T2 (SEQ ID NO:121) | 246 | 357 |
| Z25299_PEA_2_T3 (SEQ ID NO:122) | 246 | 357 |
| Z25299_PEA_2_T6 (SEQ ID NO:123) | 246 | 357 |
| Z25299_PEA_2_T9 (SEQ ID NO:124) | 246 | 357 |

Segment cluster Z25299_PEA_2_node_14 (SEQ ID NO:883) according to the present invention can be found in the following transcript(s): Z25299_PEA_2_T1 (SEQ ID NO:120), Z25299_PEA_2_T2 (SEQ ID NO:121), Z25299_PEA_2_T3 (SEQ ID NO:122), Z25299_PEA_2_T6 (SEQ ID NO:123) and Z25299_PEA_2_T9 (SEQ ID NO:124). Table 1030 below describes the starting and ending position of this segment on each transcript.

TABLE 1030

Segment location on transcripts

| Transcript name | Segment starting position | Segment ending position |
| --- | --- | --- |
| Z25299_PEA_2_T1 (SEQ ID NO:120) | 358 | 367 |
| Z25299_PEA_2_T2 (SEQ ID NO:121) | 358 | 367 |
| Z25299_PEA_2_T3 (SEQ ID NO:122) | 358 | 367 |
| Z25299_PEA_2_T6 (SEQ ID NO:123) | 358 | 367 |
| Z25299_PEA_2_T9 (SEQ ID NO:124) | 358 | 367 |

Segment cluster Z25299_PEA_2_node_17 (SEQ ID NO:884) according to the present invention can be found in the following transcript(s): Z25299_PEA_2_T1 (SEQ ID NO:120), Z25299_PEA_2_T2 (SEQ ID NO:121) and Z25299_PEA_2_T3 (SEQ ID NO:122). Table 1031 below describes the starting and ending position of this segment on each transcript.

TABLE 1031

Segment location on transcripts

| Transcript name | Segment starting position | Segment ending position |
| --- | --- | --- |
| Z25299_PEA_2_T1 (SEQ ID NO:120) | 368 | 371 |
| Z25299_PEA_2_T2 (SEQ ID NO:121) | 368 | 371 |
| Z25299_PEA_2_T3 (SEQ ID NO:122) | 368 | 371 |

Segment cluster Z25299_PEA_2_node_18 (SEQ ID NO:885) according to the present invention is supported by 221 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122) and Z25299_PEA_2_T6 (SEQ ID NO:123). Table 1032 below describes the starting and ending position of this segment on each transcript.

TABLE 1032

Segment location on transcripts

| Transcript name | Segment starting position | Segment ending position |
| --- | --- | --- |
| Z25299_PEA_2_T1 (SEQ ID NO:120) | 372 | 427 |
| Z25299_PEA_2_T2 (SEQ ID NO:121) | 372 | 427 |
| Z25299_PEA_2_T3 (SEQ ID NO:122) | 372 | 427 |
| Z25299_PEA_2_T6 (SEQ ID NO:123) | 368 | 423 |

Segment cluster Z25299_PEA_2_node_19 (SEQ ID NO:886) according to the present invention is supported by 197 libraries. The number of libraries was determined as previously described. This segment can be found in the following transcript(s): Z25299_PEA_2_T1 (SEQ ID NO:120), Z25299_PEA_2_T2 (SEQ ID NO:121), Z25299_PEA_2_T3 (SEQ ID NO:122) and Z25299_PEA_2_T6 (SEQ ID NO:123). Table 1033 below describes the starting and ending position of this segment on each transcript.

TABLE 1033

Segment location on transcripts

| Transcript name | Segment starting position | Segment ending position |
| --- | --- | --- |
| Z25299_PEA_2_T1 (SEQ ID NO:120) | 428 | 517 |
| Z25299_PEA_2_T2 (SEQ ID NO:121) | 428 | 517 |
| Z25299_PEA_2_T3 (SEQ ID NO:122) | 428 | 517 |
| Z25299_PEA_2_T6 (SEQ ID NO:123) | 424 | 513 |

Variant protein alignment to the previously known protein:

Sequence name: /tmp/oXgeQ4MeyL/K6Vqb1MQu2: ALK1_HUMAN (SEQ ID NO:1454)

Sequence documentation:

Alignment of: Z25299_PEA_2_P2 (SEQ ID NO:1390) x ALK1_HUMAN (SEQ ID NO:1454)

Alignment segment 1/1:

| | | | |
|---|---|---|---|
| Quality: | 1371.00 | Escore: | 0 |
| Matching length: | 131 | Total length: | 131 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKSSGLFPFLVLLALGTLAPWAVEGSGKSFKAGVCPPKKSAQCLRYKKPE  50
    ||||||||||||||||||||||||||||||||||||||||||||||||||
  1 MKSSGLFPFLVLLALGTLAPWAVEGSGKSFKAGVCPPKKSAQCLRYKKPE  50

51 CQSDWQCPGKKRCCPDTCGIKCLDPVDTPNPTRRKPGKCPVTYGQCLMLN 100
    |||||||||||||||||||||||||||||||||||||||||||||||||
 51 CQSDWQCPGKKRCCPDTCGIKCLDPVDTPNPTRRKPGKCPVTYGQCLMLN 100

101 PPNFCEMDGQCKRDLKCCMGMCGKSCVSPVK                    131
    |||||||||||||||||||||||||||||||
101 PPNFCEMDGQCKRDLKCCMGMCGKSCVSPVK                    131
```

Sequence name: /tmp/rbf314VLIm/yR43i4SbP4: ALK1_HUMAN (SEQ ID NO:1454)

Sequence documentation:

Alignment of: Z25299_PEA_2_P3 (SEQ ID NO:1391) x ALK1_HUMAN (SEQ ID NO:1454)

Alignment segment 1/1:

| | | | |
|---|---|---|---|
| Quality: | 1371.00 | Escore: | 0 |
| Matching length: | 131 | Total length: | 131 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1 MKSSGLFPFLVLLALGTLAPWAVEGSGKSFKAGVCPPKKSAQCLRYKKPE  50
    ||||||||||||||||||||||||||||||||||||||||||||||||||
  1 MKSSGLFPFLVLLALGTLAPWAVEGSGKSFKAGVCPPKKSAQCLRYKKPE  50

51 CQSDWQCPGKKRCCPDTCGIKCLDPVDTPNPTRRKPGKCPVTYGQCLMLN 100
    |||||||||||||||||||||||||||||||||||||||||||||||||
 51 CQSDWQCPGKKRCCPDTCGIKCLDPVDTPNPTRRKPGKCPVTYGQCLMLN 100

101 PPNFCEMDGQCKRDLKCCMGMCGKSCVSPVK                    131
    |||||||||||||||||||||||||||||||
101 PPNFCEMDGQCKRDLKCCMGMCGKSCVSPVK                    131
```

Sequence documentation:

Alignment of: Z25299_PEA_2_P7 (SEQ ID NO:1392) x ALK1_HUMAN (SEQ ID NO:1454)

Alignment segment 1/1:

| | | | |
|---|---|---|---|
| Quality: | 835.00 | Escore: | 0 |
| Matching length: | 81 | Total length: | 81 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Sequence name: /tmp/KCtSXACZXe/rK4T6LKeRX: ALK1_HUMAN (SEQ ID NO:1454)

Alignment:

```
 1 MKSSGLFPFLVLLALGTLAPWAVEGSGKSFKAGVCPPKKSAQCLRYKKPE 50
   |||||||||||||||||||||||||||||||||||||||||||||||||
 1 MKSSGLFPFLVLLALGTLAPWAVEGSGKSFKAGVCPPKKSAQCLRYKKPE 50

51 CQSDWQCPGKKRCCPDTCGIKCLDPVDTPNP                    81
   ||||||||||||||||||||||||||||||
51 CQSDWQCPGKKRCCPDTCGIKCLDPVDTPNP                    81
```

Sequence name: /tmp/LcBlcAxB6c/NSI9pqfxoU: ALK1_HUMAN (SEQ ID NO:1454)

Sequence documentation:

Alignment of: Z25299_PEA_2_P10 (SEQ ID NO:1393) x ALK1_HUMAN (SEQ ID NO:1454) . . .

Alignment segment 1/1:

| | |
|---|---|
| Quality: 844.00 | Escore: 0 |
| Matching length: 82 | Total length: 82 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1 MKSSGLFPFLVLLALGTLAPWAVEGSGKSFKAGVCPPKKSAQCLRYKKPE 50
   |||||||||||||||||||||||||||||||||||||||||||||||||
 1 MKSSGLFPFLVLLALGTLAPWAVEGSGKSFKAGVCPPKKSAQCLRYKKPE 50

51 CQSDWQCPGKKRCCPDTCGIKCLDPVDTPNPT                   82
   |||||||||||||||||||||||||||||||
51 CQSDWQCPGKKRCCPDTCGIKCLDPVDTPNPT                   82
```

Expression of Secretory Leukocyte Protease Inhibitor Acid-Stable Proteinase Inhibitor Z25299 Transcripts, which are Detectable by Amplicon as Depicted in Sequence Name Z25299 junc13-14-21 (SEQ ID NO:1666) in Normal and cancerous lung Tissues Expression of Secretory leukocyte protease inhibitor Acid-stable proteinase inhibitor transcripts detectable by or according to junc13-14-21, Z25299 junc13-14-21 amplicon (SEQ ID NO:1666) and Z25299 junc13-14-21F (SEQ ID NO:1664) and Z25299 junc13-14-21R (SEQ ID NO:1665) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 "Tissue sample in testing panel", above), to obtain a value of fold differential expression for each sample relative to median of the normal PM samples.

Figure 36:
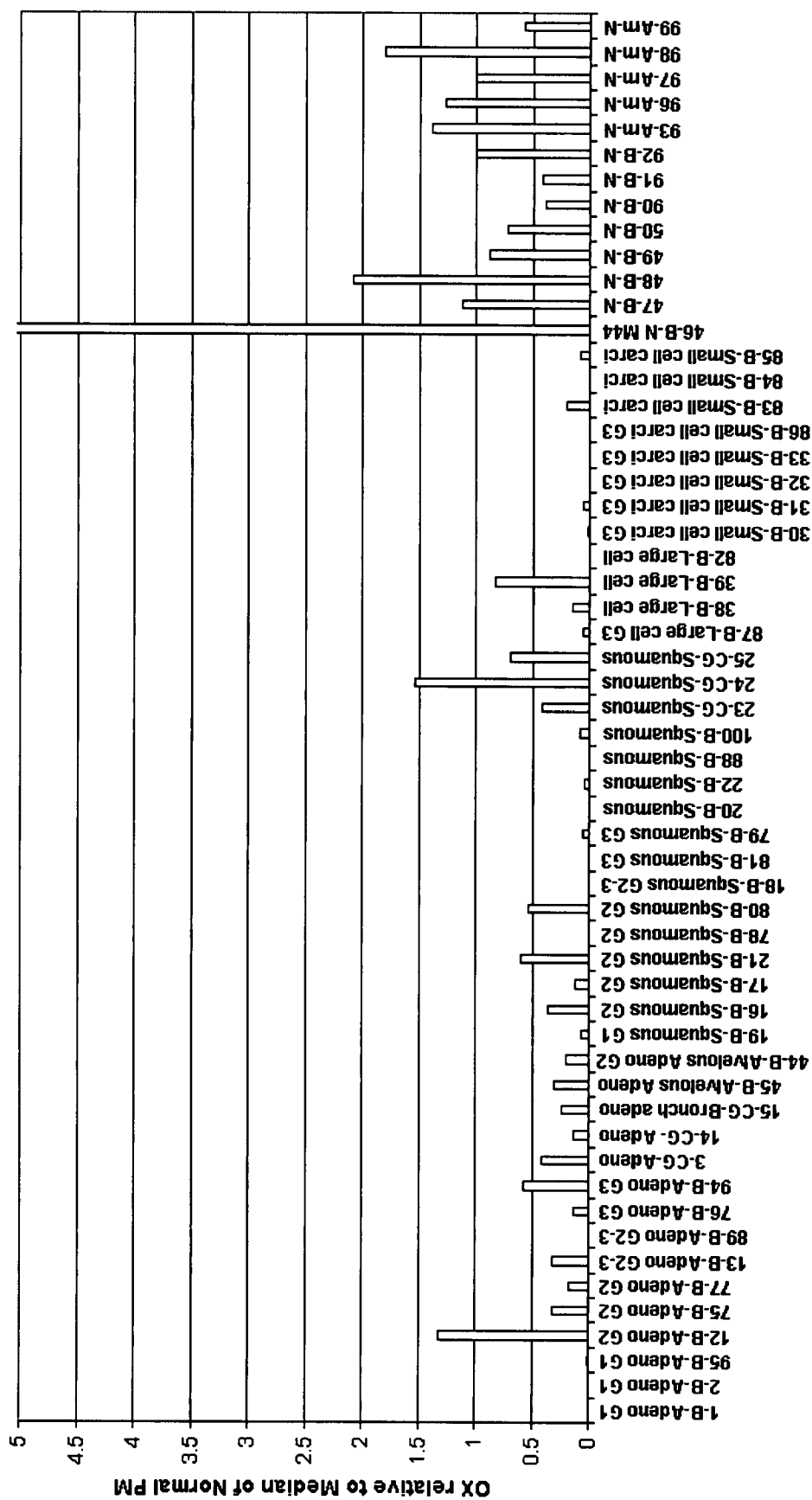
FIG. 36 is a histogram showing down regulation of the Secretory leukocyte protease inhibitor Acid-stable proteinase inhibitor Z25299 transcripts, which are detectable by amplicon as depicted in sequence name Z25299 junc13-14-21 (SEQ ID NO:1666), in cancerous lung samples relative to the normal samples.

FIG. 36 is a histogram showing down regulation of the above-indicated Secretory leukocyte protease inhibitor Acid-stable proteinase inhibitor transcripts in cancerous lung samples relative to the normal samples.

As is evident from FIG. 36, the expression of Secretory leukocyte protease inhibitor Acid-stable proteinase inhibitor transcripts detectable by the above amplicon(s) in cancer samples was significantly lower than in the non-cancerous samples (Sample Nos. 47-50, 90-93, 96-99 Table 2, "Tissue sample in testing panel").

Statistical analysis was applied to verify the significance of these results, as described below.

The P value for the difference in the expression levels of Secretory leukocyte protease inhibitor Acid-stable proteinase inhibitor transcripts detectable by the above amplicon(s) in lung cancer samples versus the normal tissue samples was determined by T test as 1.98E-04. This value demonstrates statistical significance of the results.

Primer pairs are also optionally and preferably encompassed within the present invention; for example, for the above experiment, the following primer pair was used as a non-limiting illustrative example only of a suitable primer pair: Z25299 junc13-14-21F forward primer (SEQ ID NO:1664); and Z25299 junc13-14-21R reverse primer (SEQ ID NO:1665).

The present invention also preferably encompasses any amplicon obtained through the use of any suitable primer pair; for example, for the above experiment, the following amplicon was obtained as a non-limiting illustrative example only of a suitable amplicon: Z25299 junc13-14-21 (SEQ ID NO:1666).

Forward primer (SEQ ID NO: 1664): ACCCCAAAC-CCAACTTGATTC-

Reverse primer (SEQ ID NO: 1665): TCAGTGGTGGAGC-CAAGTCTC

Amplicon (SEQ ID NO: 1666): ACCCCAAACCCAACT-TGATTCCTGCCATATGGAGGAGGCTCTGGAGTCC-TGCTCTGTGTGGTCCAGGT CCTTTCCACCCT-GAGACTTGGCTCCACCACTGA Z25299 Transcripts, which are Detectable by Amplicon as Depicted in Sequence Name Z25299 seg20 (SEQ ID NO: 1669) in Normal and Cancerous Lung Tissues Expression of Secretory leukocyte protease inhibitor Acid-stable proteinase inhibitor transcripts detectable by or according to seg20, Z25299 seg20 amplicon (SEQ ID NO:1669) and Z25299 seg20F (SEQ ID NO:1667) and Z25299 seg20R (SEQ ID NO:1668) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above). Then the reciprocal of this ratio was calculated, to obtain a value of fold down-regulation for each sample relative to median of the normal PM samples.

Figure 37:
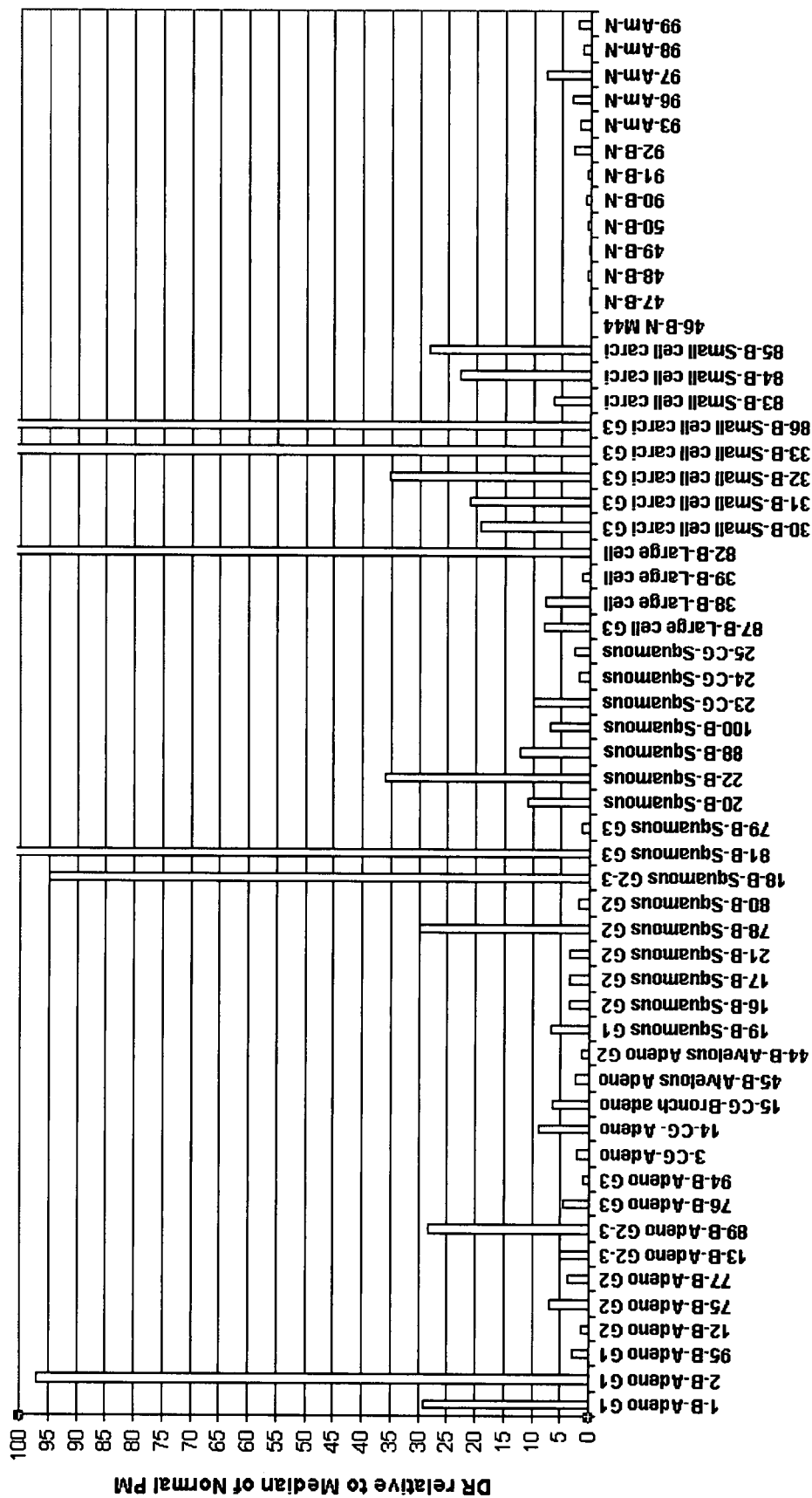
FIG. 37 is a histogram showing down regulation of the Secretory leukocyte protease inhibitor Acid-stable proteinase inhibitor Z25299 transcripts, which are detectable by amplicon as depicted in sequence name Z25299 seg20 (SEQ ID NO:1669), in cancerous lung samples relative to the normal samples.

FIG. 37 is a histogram showing down regulation of the above-indicated Secretory leukocyte protease inhibitor Acid-stable proteinase inhibitor transcripts in cancerous lung samples relative to the normal samples. The number and percentage of samples that exhibit at least 5 fold down regulation, out of the total number of samples tested is indicated in the bottom.

As is evident from FIG. 37, the expression of Secretory leukocyte protease inhibitor Acid-stable proteinase inhibitor transcripts detectable by the above amplicon(s) in cancer samples was significantly lower than in the non-cancerous samples (Sample Nos. 47-50, 90-93, 96-99 Table 2, "Tissue sample in testing panel"). Notably an down regulation of at least 5 fold was found in 6 out of 15 adenocarcinoma samples, 9 out of 16 squamous cell carcinoma samples, 3 out of 4 large cell carcinoma samples and in 8 out of 8 small cell carcinoma samples.

Statistical analysis was applied to verify the significance of these results, as described below.

The P value for the difference in the expression levels of Secretory leukocyte protease inhibitor Acid-stable proteinase inhibitor transcripts detectable by the above amplicon(s) in lung cancer samples versus the normal tissue samples was determined by T test as 9.43E-02 in adenocarcinoma, 5.62E-02 in squamous cell carcinoma, 3.38E-01 in large cell carcinoma and 3.78E-02 in small cell carcinoma.

Threshold of 5 fold down regulation was found to differentiate between cancer and normal samples with P value of 3.73E-02 in adenocarcinoma, 1.10E-02 in squamous cell carcinoma, 2.64E-02 in large cell carcinoma and 7.14E-05 in small cell carcinoma checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: Z25299 seg20F forward primer (SEQ ID NO: 1667); and Z25299 seg20R reverse primer (SEQ ID NO: 1668).

The present invention also preferably encompasses any amplicon obtained through the use of any suitable primer pair; for example, for the above experiment, the following amplicon was obtained as a non-limiting illustrative example only of a suitable amplicon: Z25299 seg20 (SEQ ID NO:1669).

Forward primer (SEQ ID NO: 1667): CTCCTGAAC-CCTACTCCAAGCA

Reverse primer (SEQ ID NO: 1668): CAGGCGATC-CTATGGAAATCC

Amplicon (SEQ ID NO: 1669): CTCCTGAAC-CCTACTCCAAGCACAGCCTCTGTCT-GACTCCCTTGTCCTTCAAGAGAACTGTTCTCCAGG TCTCAGGGCCAGGATTTCCATAGGATCGCCTG Expression of *Homo Sapiens* Secretory Leukocyte Protease Inhibitor (antileukoproteinase) (SLPI) Z25299 Transcripts which are Detectable by Amplicon as Depicted in Sequence Name Z25299 seg23(SEQ ID NO:1672) in Normal and Cancerous Lung Tissues Expression of *Homo sapiens* secretory leukocyte protease inhibitor (antileukoproteinase) (SLPI) transcripts detectable by or according to seg23, Z25299 seg23 amplicon (SEQ ID NO: 1672) and primers Z25299 seg23F (SEQ ID NO:1670) and Z25299 seg23R (SEQ ID NO: 1671) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above). Then the reciprocal of this ratio was calculated, to obtain a value of fold down-regulation for each sample relative to median of the normal PM samples.

Figure 68:
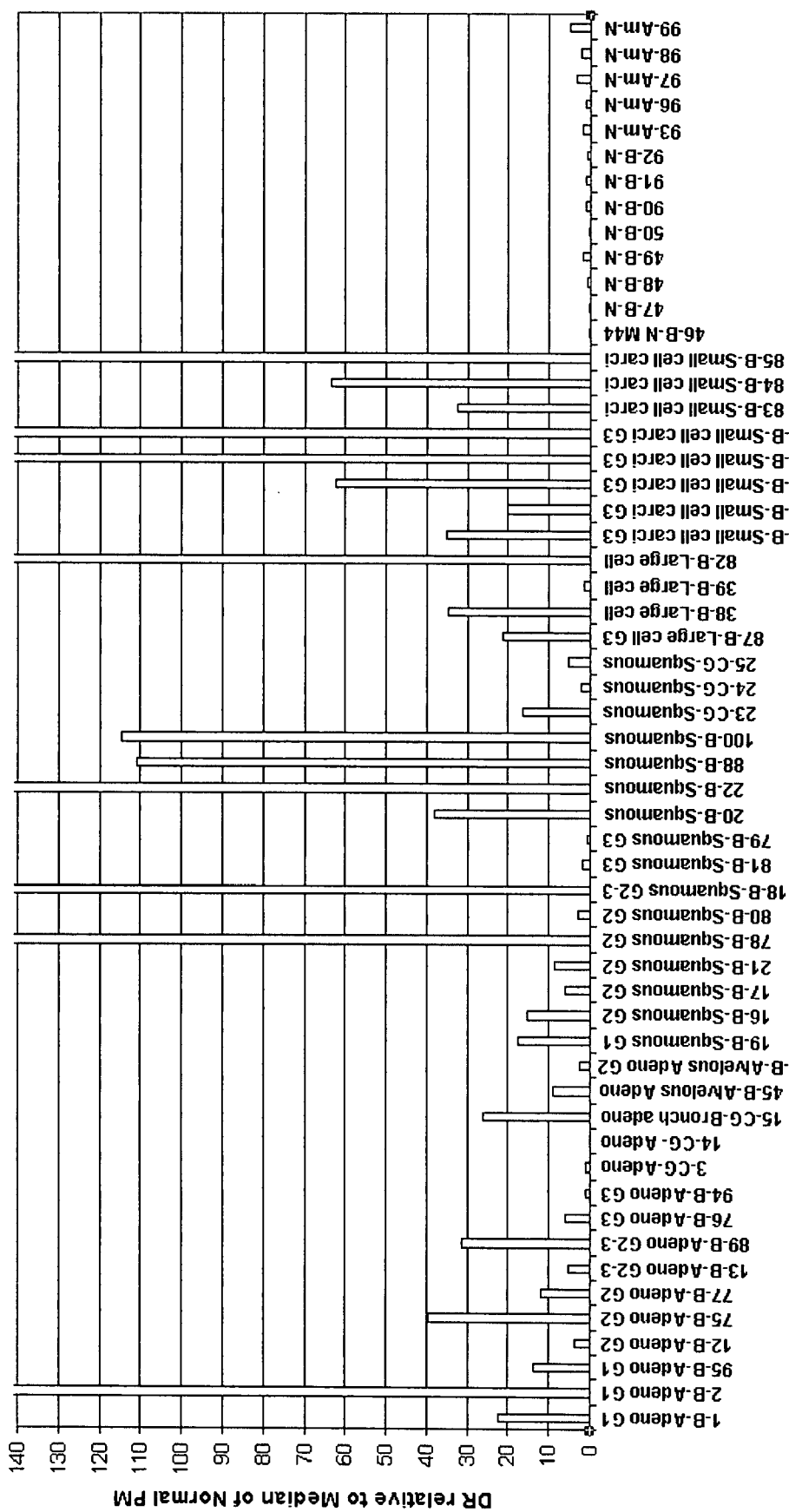
FIG. 68 is a histogram showing down regulation of the Homo sapiens secretory leukocyte protease inhibitor (anti-leukoproteinase) (SLPI) Z25299 transcripts which are detectable by amplicon as depicted in sequence name Z25299 seg23 (SEQ ID NO: 1672) in cancerous lung samples relative to the normal samples.

FIG. 68 is a histogram showing down regulation of the above-indicated *Homo sapiens* secretory leukocyte protease inhibitor (antileukoproteinase) (SLPI) transcripts in cancerous lung samples relative to the normal samples.

As is evident from FIG. 68, the expression of *Homo sapiens* secretory leukocyte protease inhibitor (antileukoproteinase) (SLPI) transcripts detectable by the above amplicon(s) in cancer samples was significantly lower than in the non-cancerous samples (Sample Nos. 46-50, 90-93, 96-99 Table 2). Notably down regulation of at least 10 fold was found in 7 out of 15 adenocarcinoma samples, 9 out of 16 squamous cell carcinoma samples, 3 out of 4 large cell carcinoma samples and in 8 out of 8 small cells carcinoma samples.

Primer pairs are also optionally and preferably encompassed within the present invention; for example, for the above experiment, the following primer pair was used as a non-limiting illustrative example only of a suitable primer pair: Z25299 seg23F forward primer (SEQ ID NO:1670); and Z25299 seg23R reverse primer (SEQ ID NO: 1671).

The present invention also preferably encompasses any amplicon obtained through the use of any suitable primer pair; for example, for the above experiment, the following amplicon was obtained as a non-limiting illustrative example only of a suitable amplicon: Z25299 seg23 (SEQ ID NO:1672).

Primers:

Forward primer Z25299 seg23F (SEQ ID NO:1670): CAAGCAATTGAGGGACCAGG

Reverse primer Z25299 seg23R (SEQ ID NO:1671): CAAAAAACATTGTTAATGAGAGAGATGAC

Amplicon Z25299 seg23F (SEQ ID NO:1672): CAAGCAATTGAGGGACCAGGAAGTGGATCCTCTAGAGATGAGGAGGCATTCTGCTGGATGACTTTTA AAAATGTTTTCTCCAGAGTCATCTCTCTCATTAACAATGTTTTTTG Expression of Secretory Leukocyte Protease Inhibitor Acid-Stable Proteinase Inhibitor Z25299 Transcripts which are Detectable by Amplicon as Depicted in Sequence Name Z25299seg20 (SEQ ID NO:1669) in Different Normal Tissues Expression of Secretory leukocyte protease inhibitor transcripts detectable by or according to Z25299seg20 amplicon (SEQ ID NO: 1669) and primers: Z25299seg23F (SEQ ID NO:1667) Z25299seg20R (SEQ ID NO: 1668) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Primers:

Forward primer (SEQ ID NO: 1667): CTCCTGAACCCTACTCCAAGCA

Reverse primer (SEQ ID NO: 1668): CAGGCGATCCTATGGAAATCC

Figure 69:
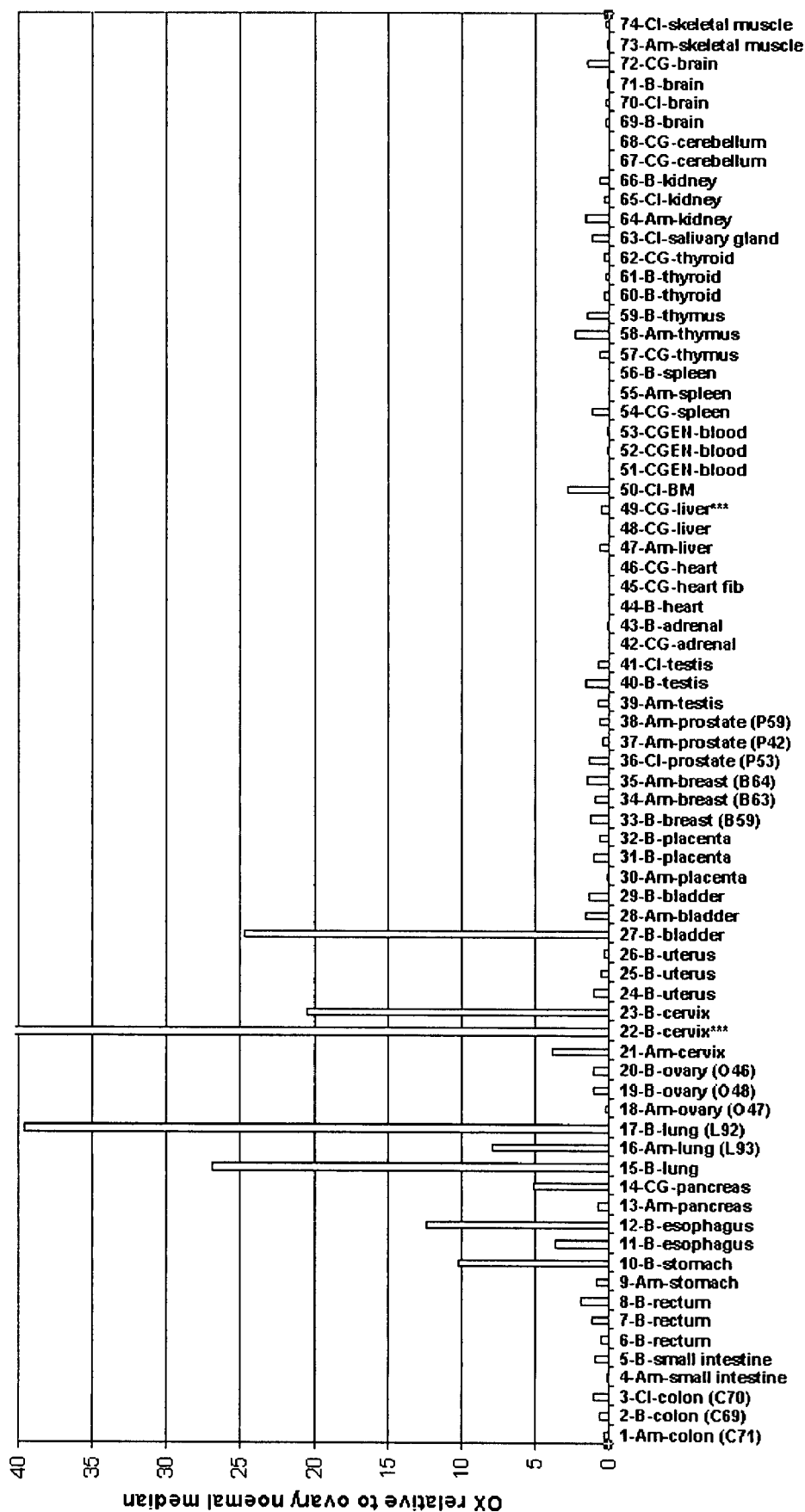
FIG. 69 is a histogram showing the expression of Secretory leukocyte protease inhibitor Acid-stable proteinase inhibitor Z25299 transcripts which are detectable by amplicon as depicted in sequence name Z25299seg20 (SEQ ID NO: 1669) in different normal tissues.

Amplicon (SEQ ID NO: 1669): CTCCTGAACCCTACTCCAAGCACAGCCTCTGTCTGACTCCCTTGTCCTTCAAGAGAACTGTTCTCCAGG TCTCAGGGCCAGGATTTCCATAGGATCGCCTG The results are demonstrated in FIG. 69, showing the expression of Secretory leukocyte protease inhibitor Acid-stable proteinase inhibitor Z25299 transcripts which are detectable by amplicon as depicted in sequence name Z25299seg20 (SEQ ID NO: 1669) in different normal tissues.

Expression of Secretory Leukocyte Protease Inhibitor Z25299 Transcripts which are Detectable by Amplicon as Depicted in Sequence Name Z25299seg23 (SEQ ID NO: 1672) in Different Normal Tissues Expression of Secretory leukocyte protease inhibitor transcripts detectable by or according to Z25299seg23 amplicon (SEQ ID NO: 1672) and primers: Z25299seg23F (SEQ ID NO: 1670) Z25299seg23R (SEQ ID NO: 1671) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 3), to obtain a value of relative expression of each sample relative to median of the ovary samples.

Primers:

Forward primer Z25299 seg23F (SEQ ID NO:1670): CAAGCAATTGAGGGACCAGG

Reverse primer Z25299 seg23R (SEQ ID NO:1671): CAAAAAACATTGTTAATGAGAGAGATGAC

Figure 70:
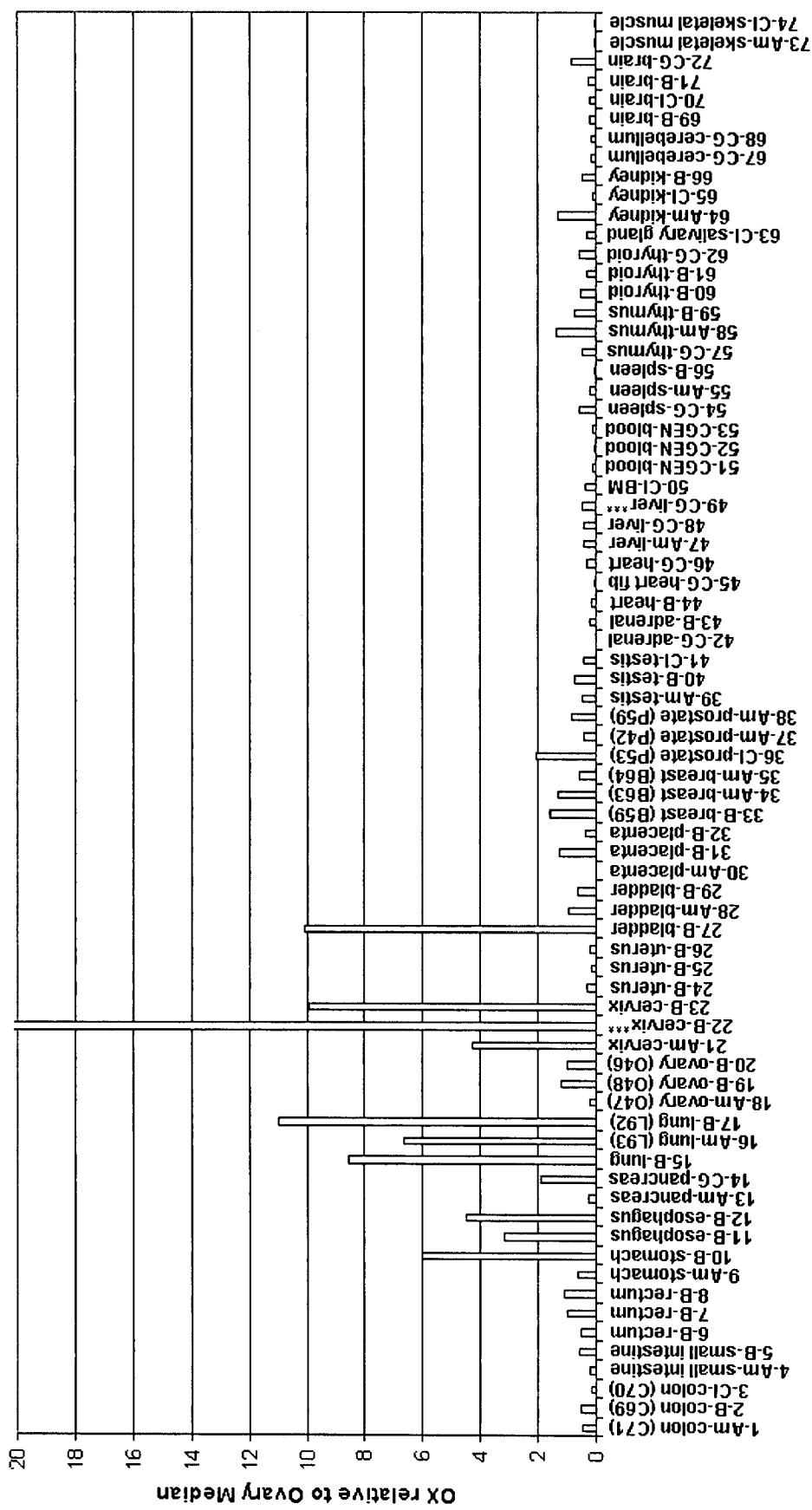
FIG. 70 is a histogram showing the expression of Secretory leukocyte protease inhibitor Acid-stable proteinase inhibitor Z25299 transcripts which are detectable by amplicon as depicted in sequence name Z25299seg23 (SEQ ID NO: 1672) in different normal tissues.

Amplicon Z25299 seg23F (SEQ ID NO:1672): CAAGCAATTGAGGGACCAGGAAGTGGATCCTCTAGAGATGAGGAGGCATTCTGCTGGATGACTTTTA AAAATGTTTTCTCCAGAGTCATCTCTCTCATTAACAATGTTTTG The results are demonstrated in FIG. 70, showing the expression of Secretory leukocyte protease inhibitor Acid-stable proteinase inhibitor Z25299 transcripts which are detectable by amplicon as depicted in sequence name Z25299seg23 (SEQ ID NO:1672) in different normal tissues.

Description for Cluster HSSTROL3

Cluster HSSTROL3 features 6 transcript(s) and 16 segment(s) of interest, the names for which are given in Tables 1034 and 1035, respectively, the sequences themselves are given at the end of the application. The selected protein variants are given in table 1036.

TABLE 1034

Transcripts of interest

| Transcript Name | Sequence ID No. |
|---|---|
| HSSTROL3_T5 | 125 |
| HSSTROL3_T8 | 126 |
| HSSTROL3_T9 | 127 |
| HSSTROL3_T10 | 128 |
| HSSTROL3_T11 | 129 |
| HSSTROL3_T12 | 130 |

TABLE 1035

Segments of interest

| Segment Name | Sequence ID No. |
| --- | --- |
| HSSTROL3_node_6 | 887 |
| HSSTROL3_node_10 | 888 |
| HSSTROL3_node_13 | 889 |
| HSSTROL3_node_15 | 890 |
| HSSTROL3_node_19 | 891 |
| HSSTROL3_node_21 | 892 |
| HSSTROL3_node_24 | 893 |
| HSSTROL3_node_25 | 894 |
| HSSTROL3_node_26 | 895 |
| HSSTROL3_node_28 | 896 |
| HSSTROL3_node_29 | 897 |
| HSSTROL3_node_11 | 898 |
| HSSTROL3_node_17 | 899 |
| HSSTROL3_node_18 | 900 |
| HSSTROL3_node_20 | 901 |
| HSSTROL3_node_27 | 902 |

TABLE 1036

Proteins of interest

| Protein Name | Sequence ID No. | Corresponding Transcript(s) |
| --- | --- | --- |
| HSSTROL3_P4 | 1394 | HSSTROL3_T5 (SEQ ID NO:125) |
| HSSTROL3_P5 | 1395 | HSSTROL3_T8 (SEQ ID NO:126); HSSTROL3_T9 (SEQ ID NO:127) |
| HSSTROL3_P7 | 1396 | HSSTROL3_T10 (SEQ ID NO:128) |
| HSSTROL3_P8 | 1397 | HSSTROL3_T11 (SEQ ID NO:129) |
| HSSTROL3_P9 | 1398 | HSSTROL3_T12 (SEQ ID NO:130) |

These sequences are variants of the known protein Stromelysin-3 precursor (SwissProt accession identifier MM11_HUMAN; known also according to the synonyms EC 3.4.24.-; Matrix metalloproteinase-11; MMP-1; ST3; SL-3), SEQ ID NO:1455, referred to herein as the previously known protein.

Protein Stromelysin-3 precursor (SEQ ID NO:1455) is known or believed to have the following function(s): May play an important role in the progression of epithelial malignancies. The sequence for protein Stromelysin-3 precursor is given at the end of the application, as "Stromelysin-3 precursor amino acid sequence".

The following GO Annotation(s) apply to the previously known protein. The following annotation(s) were found: proteolysis and peptidolysis; developmental processes; morphogenesis, which are annotation(s) related to Biological Process; stromelysin 3; calcium binding; zinc binding; hydrolase, which are annotation(s) related to Molecular Function; and extracellular matrix, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HSSTROL3 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 38 refer to weighted expression of ESTs in each category, as "parts per million" (ratio of the expression of ESTs for a particular cluster to the expression of all ESTs in that category, according to parts per million).

Figure 38:
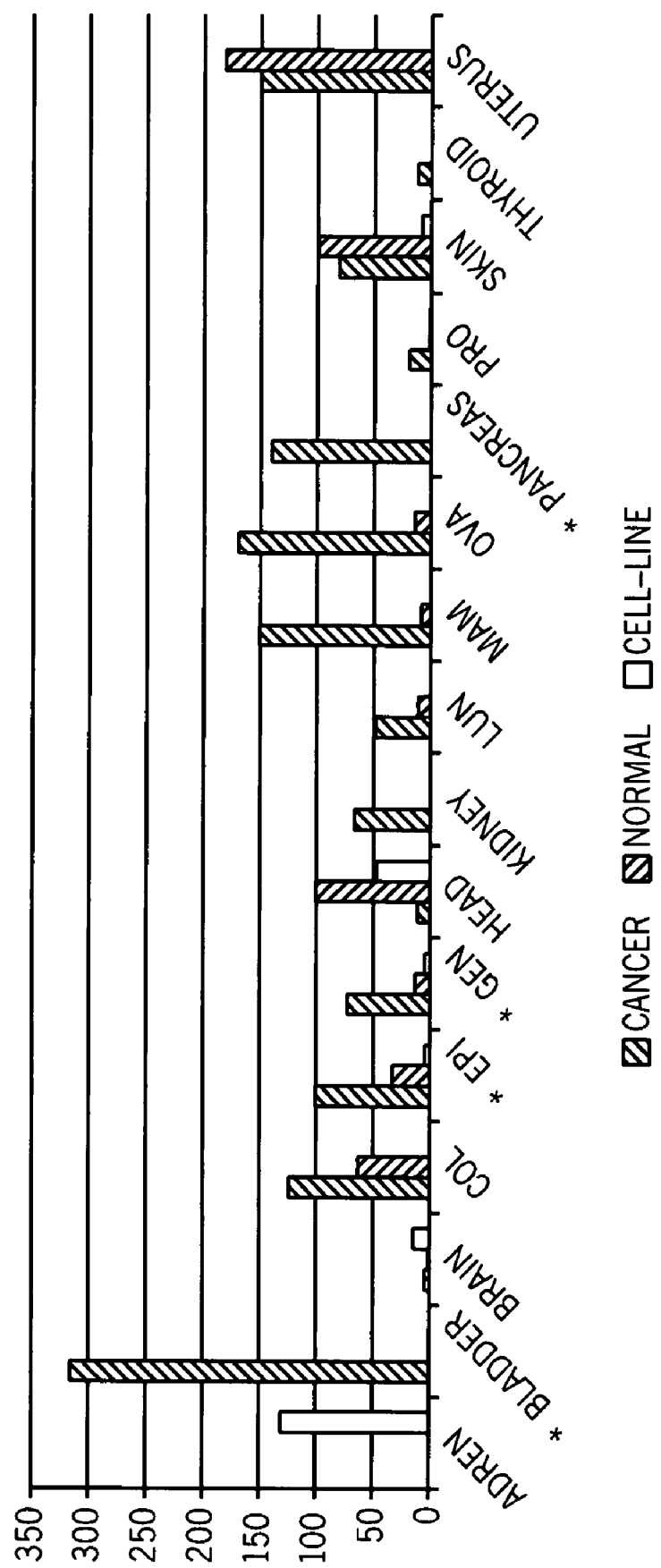
FIG. 38 is a histogram showing Cancer and cell-line vs. normal tissue expression for Cluster HSSTROL3, demonstrating overexpression in transitional cell carcinoma, epithelial malignant tumors, a mixture of malignant tumors from different tissues and pancreas carcinoma.

Overall, the following results were obtained as shown with regard to the histograms in FIG. 38 and Table 1037. This cluster is overexpressed (at least at a minimum level) in the following pathological conditions: transitional cell carcinoma, epithelial malignant tumors, a mixture of malignant tumors from different tissues and pancreas carcinoma.

TABLE 1037

Normal tissue distribution

| Name of Tissue | Number |
| --- | --- |
| adrenal | 0 |
| bladder | 0 |
| brain | 1 |
| colon | 63 |
| epithelial | 33 |
| general | 13 |
| head and neck | 101 |
| kidney | 0 |
| lung | 11 |
| breast | 8 |
| ovary | 14 |
| pancreas | 0 |
| prostate | 2 |
| skin | 99 |
| Thyroid | 0 |
| uterus | 181 |

TABLE 1038

P values and ratios for expression in cancerous tissue

| Name of Tissue | P1 | P2 | SP1 | R3 | SP2 | R4 |
| --- | --- | --- | --- | --- | --- | --- |
| adrenal | 1 | 4.6e-01 | 1 | 1.0 | 5.3e-01 | 1.9 |
| bladder | 2.7e-01 | 3.4e-01 | 3.3e-03 | 4.9 | 2.1e-02 | 3.3 |
| brain | 3.5e-01 | 2.6e-01 | 1 | 1.7 | 3.3e-01 | 2.8 |
| colon | 7.7e-02 | 1.5e-01 | 3.1e-01 | 1.4 | 5.2e-01 | 1.0 |
| epithelial | 1.2e-04 | 1.2e-02 | 1.3e-06 | 2.7 | 4.6e-02 | 1.4 |
| general | 5.4e-09 | 3.1e-05 | 1.8e-16 | 5.0 | 3.1e-07 | 2.6 |
| head and neck | 4.6e-01 | 4.3e-01 | 1 | 0.6 | 9.4e-01 | 0.7 |
| kidney | 2.5e-01 | 3.5e-01 | 1.1e-01 | 4.0 | 2.4e-01 | 2.8 |
| lung | 1.8e-01 | 4.5e-01 | 1.9e-01 | 2.7 | 5.1e-01 | 1.4 |
| breast | 2.0e-01 | 3.4e-01 | 7.3e-02 | 3.3 | 2.5e-01 | 2.0 |
| ovary | 2.6e-01 | 3.2e-01 | 2.2e-02 | 2.0 | 7.0e-02 | 1.6 |
| pancreas | 9.5e-02 | 1.8e-01 | 1.8e-04 | 7.8 | 1.6e-03 | 5.5 |
| prostate | 8.2e-01 | 7.8e-01 | 4.5e-01 | 1.8 | 5.6e-01 | 1.5 |
| skin | 5.2e-01 | 5.8e-01 | 7.1e-01 | 0.8 | 1 | 0.3 |
| Thyroid | 2.9e-01 | 2.9e-01 | 1 | 1.1 | 1 | 1.1 |
| uterus | 4.2e-01 | 8.0e-01 | 7.5e-01 | 0.6 | 9.9e-01 | 0.4 |

As noted above, cluster HSSTROL3 features 6 transcript(s), which were listed in Table 1034 above. These transcript(s) encode for protein(s) which are variant(s) of protein Stromelysin-3 precursor (SEQ ID NO:1455). A description of each variant protein according to the present invention is now provided.

Variant protein HSSTROL3_P4 (SEQ ID NO:1394) according to the present invention has an amino acid sequence as given at the end of the application; it is encoded by transcript(s) HSSTROL3_T5 (SEQ ID NO:125). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison report between HSSTROL3_P4 (SEQ ID NO:1394) and MM11_HUMAN (SEQ ID NO:1455)

1. An isolated chimeric polypeptide encoding for HSSTROL3_P4 (SEQ ID NO:1394), comprising a first amino acid sequence being at least 90% homologous to MAPAAWLRSAAARALLPPMLLLLLQPP-PLLAPALPPDVHHLHAERRGPQPWHAALPSSPAPA-PATQEAPR PASSLRPPPRCGVPDPSDGLSARN-RQKRFVLSGGRWEKTDLTYRILRFPWQLVQEQVRQ-TMAEALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P4 (SEQ ID NO:1394), a bridging amino acid H corresponding to amino acid 164 of HSSTROL3_P4 (SEQ ID NO:1394), a second amino acid sequence being at least 90% homologous to GDDLPFDG-PGGILAHAFFPKTHREGDVHFDYDET-WTIGDDQGTDLLQVAAHEFGHVLGLQHTTAAKALM SAFYTFRYPLSLSPDDCRGVQHLYGQPWPTVTSRTP-ALGPQAGIDTNEIAPLEPDAPPDACEASFDAVSTIR GELFFFKAGFVWRLRGGQLQPGYPALASRHWQGL-PSPVDAAFEDAQGHIWFFQGAQYWVYDGEKPV-LG PAPLTELGLVRFPVHAALVWGPEKNKIYFFRG-RDYWRFHPSTRRVDSPVPRRATDWRGVPSEI-DAAFQDA DG corresponding to amino acids 165-445 of MM11_HUMAN (SEQ ID NO:1455), which also corresponds to amino acids 165-445 of HSSTROL3_P4 (SEQ ID NO:1394), and a third amino acid sequence being at least 70%, optionally at least 80%, preferably at least 85%, more preferably at least 90% and most preferably at least 95% homologous to a polypeptide having the sequence ALGVRQLVGGGHSSRFSHLVVAGL-PHACHRKSGSSSQVLCPEPSALLSVAG (SEQ ID NO: 251) corresponding to amino acids 446-496 of HSSTROL3_P4 (SEQ ID NO:1394), wherein said first amino acid sequence, bridging amino acid, second amino acid sequence and third amino acid sequence are contiguous and in a sequential order.

2. An isolated polypeptide encoding for a tail of HSSTROL3_P4 (SEQ ID NO:1394), comprising a polypeptide being at least 70%, optionally at least about 80%, preferably at least about 85%, more preferably at least about 90% and most preferably at least about 95% homologous to the sequence ALGVRQLVGGGHSSRFSHLVVAGL-PHACHRKSGSSSQVLCPEPSALLSVAG (SEQ ID NO: 251) in HSSTROL3_P4 (SEQ ID NO:1394).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P4 (SEQ ID NO:1394) also has the following non-silent SNPs (Single Nucleotide Polymorphisms) as listed in Table 1039, (given according to their position(s) on the amino acid sequence, with the alternative amino acid(s) listed; the last column indicates whether the SNP is known or not; the presence of known SNPs in variant protein HSSTROL3_P4 (SEQ ID NO:1394) sequence provides support for the deduced sequence of this variant protein according to the present invention).

TABLE 1039

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |
| 323 | Q -> H | Yes |

Variant protein HSSTROL3_P4 (SEQ ID NO:1394) is encoded by the following transcript(s): HSSTROL3_T5 (SEQ ID NO:125), for which the sequence(s) is/are given at the end of the application. The coding portion of transcript HSSTROL3_T5 (SEQ ID NO:125) is shown in bold; this coding portion starts at position 24 and ends at position 1511. The transcript also has the following SNPs as listed in Table 1040 (given according to their position on the nucleotide sequence, with the alternative nucleic acid listed; the last column indicates whether the SNP is known or not; the presence of known SNPs in variant protein HSSTROL3_P4 (SEQ ID NO:1394) sequence provides support for the deduced sequence of this variant protein according to the present invention).

TABLE 1040

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1528 | A -> G | Yes |
| 1710 | A -> G | Yes |
| 2251 | A -> G | Yes |
| 2392 | C -> | No |
| 2444 | C -> A | Yes |
| 2470 | A -> T | Yes |
| 2687 | -> G | No |
| 2696 | -> G | No |
| 2710 | C -> | No |
| 2729 | -> A | No |
| 2755 | T -> C | No |
| 2813 | A -> | No |
| 2813 | A -> C | No |
| 2963 | A -> | No |
| 2963 | A -> C | No |
| 2993 | T -> C | Yes |
| 3140 | -> T | No |

Variant protein HSSTROL3_P5 (SEQ ID NO:1395) according to the present invention has an amino acid sequence as given at the end of the application; it is encoded by transcript(s) HSSTROL3_T8 (SEQ ID NO:126) and HSSTROL3_T9 (SEQ ID NO:127). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison report between HSSTROL3_P5 (SEQ ID NO:1395) and MM11_HUMAN (SEQ ID NO:1455)

1. An isolated chimeric polypeptide encoding for HSSTROL3_P5 (SEQ ID NO:1395), comprising a first amino acid sequence being at least 90% homologous to MAPAAWLRSAAARALLPPMLLLLLQPPPLLARALP-PDVHHLHAERRGPQPWHAALPSSPAPAPATQEAPR PASSLRPPRCGVPDSDGLSARNRQKRFVLSGGR-WEKTDLTYRILRFPWQLVQEQVRQTMAEAL-KVWSD VTPLTFTEVHEGRADIMIDFARYW corresponding to amino acids 1-163 of MM11_HUMAN (SEQ ID NO:1455), which also corresponds to amino acids 1-163 of HSSTROL3_P5 (SEQ ID NO:1395), a bridging amino acid H corresponding to amino acid 164 of HSSTROL3_P5 (SEQ ID NO:1395), a second amino acid sequence being at least 90% homologous to GDDLPFDGPGGILAHAFFPKTHREGD-VHFDYDETWTIGDDQGTDLLQVAAHEFGHVLG-LQHTTAAKALM SAFYTFRYPLSLSPDDCRGVQH-LYGQPWPTVTSRTPALGPQAGIDTNEIAPLEPDAPPD-ACEASFDAVSTIR GELFFFKAGFVWRLRGGQLQPGY-PALASRHWQGLPSPVDAAFEDAQGHIWFFQ corresponding to amino acids 165-358 of MM11_HUMAN (SEQ ID NO:1455), which also corresponds to amino acids 165-358 of HSSTROL3_P5 (SEQ ID NO:1395), and a third amino acid sequence being at least 70%, optionally at least 80%, preferably at least 85%, more preferably at least 90% and most preferably at least 95% homologous to a polypeptide having the sequence ELGFPSSTGRDESLEHCRCQGLHK (SEQ ID NO: 252) corresponding to amino acids 359-382 of HSSTROL3_P5 (SEQ ID NO:1395), wherein said first amino acid sequence, bridging amino acid, second amino acid sequence and third amino acid sequence are contiguous and in a sequential order.

2. An isolated polypeptide encoding for a tail of HSSTROL3_P5 (SEQ ID NO:1395), comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO: 252) in HSSTROL3_P5 (SEQ ID NO:1395).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P5 (SEQ ID NO:1395) also has the following non-silent SNPs (Single Nucleotide Polymorphisms) as listed in Table 1041, (given according to their position(s) on the amino acid sequence, with the alternative amino acid(s) listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1041

Amino acid mutations

| SNP position(s) on amino acid sequence | Alternative amino acid(s) | Previously known SNP? |
|---|---|---|
| 38 | V -> A | Yes |
| 104 | R -> P | Yes |

TABLE 1041-continued

Amino acid mutations

| SNP position(s) on amino acid sequence | Alternative amino acid(s) | Previously known SNP? |
|---|---|---|
| 214 | A -> | No |
| 323 | Q -> H | Yes |

Variant protein HSSTROL3_P5 (SEQ ID NO:1395) is encoded by the following transcript(s): HSSTROL3_T8 (SEQ ID NO:126) and HSSTROL3_T9 (SEQ ID NO:127), for which the sequence(s) is/are given at the end of the application.

The coding portion of transcript HSSTROL3_T8 (SEQ ID NO:126) is shown in bold; this coding portion starts at position 24 and ends at position 1169. The transcript also has the following SNPs as listed in Table 1042 (given according to their position on the nucleotide sequence, with the alternative nucleic acid listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1042

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1903 | C -> | No |
| 1955 | C -> A | Yes |
| 1981 | A -> T | Yes |
| 2198 | -> G | No |
| 2207 | -> G | No |
| 2221 | C -> | No |
| 2240 | -> A | No |
| 2266 | T -> C | No |
| 2324 | A -> | No |
| 2324 | A -> C | No |
| 2474 | A -> | No |
| 2474 | A -> C | No |
| 2504 | T -> C | Yes |
| 2651 | -> T | No |

The coding portion of transcript HSSTROL3_T9 (SEQ ID NO:127) is shown in bold; this coding portion starts at position 24 and ends at position 1169. The transcript also has the following SNPs as listed in Table 1043 (given according to their position on the nucleotide sequence, with the alternative nucleic acid listed; the last column indicates whether the SNP is known or not; the presence of known SNPs in variant protein HSSTROL3_P5 (SEQ ID NO:1395) sequence provides support for the deduced sequence of this variant protein according to the present invention).

TABLE 1043

Nucleic acid SNPs

| SNP position on nucleotide sequence | Alternative nucleic acid | Previously known SNP? |
|---|---|---|
| 136 | T -> C | Yes |
| 334 | G -> C | Yes |

TABLE 1043-continued

Nucleic acid SNPs

| SNP position on nucleotide sequence | Alternative nucleic acid | Previously known SNP? |
|---|---|---|
| 663 | G -> | No |
| 699 | -> T | No |
| 992 | G -> C | Yes |
| 1666 | A -> G | Yes |
| 1848 | A -> G | Yes |
| 2389 | A -> G | Yes |
| 2530 | C -> | No |
| 2582 | C -> A | Yes |
| 2608 | A -> T | Yes |
| 2825 | -> G | No |
| 2834 | -> G | No |
| 2848 | C -> | No |
| 2867 | -> A | No |
| 2893 | T -> C | No |
| 2951 | A -> | No |
| 2951 | A -> C | No |
| 3101 | A -> | No |
| 3101 | A -> C | No |
| 3131 | T -> C | Yes |
| 3278 | -> T | No |

Variant protein HSSTROL3_P7 (SEQ ID NO:1396) according to the present invention has an amino acid sequence as given at the end of the application; it is encoded by transcript(s) HSSTROL3_T10 (SEQ ID NO:128). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison report between HSSTROL3_P7 (SEQ ID NO:1396) and MM11_HUMAN (SEQ ID NO:1455)

1. An isolated chimeric polypeptide encoding for HSSTROL3_P7 (SEQ ID NO:1396), comprising a first amino acid sequence being at least 90% homologous to MAPAAWLRSAAARALLPPMLLLLLQPP-PLLARALPPDVHHLHAERRGPQPWHAALPSSPAPAP-ATQEAPR PASSLRPPRCGVPDPSDGLSARN-RQKRFVLSGGRWEKTDLTYRILRFPWQLVQEQV-RQTMAEALKVWSD VTPLTFTEVHEGRADIMID-FARYW corresponding to amino acids 1-163 of MM11_HUMAN (SEQ ID NO:1455), which also corresponds to amino acids 1-163 of HSSTROL3_P7 (SEQ ID NO:1396), a bridging amino acid H corresponding to amino acid 164 of HSSTROL3_P7 (SEQ ID NO:1396), a second amino acid sequence being at least 90% homologous to GDDLPFDGPGGILAHAFFPKTHREGDVH-FDYDETWTIGDDQGTDLLQVAAHEFGHV-LGLQHTTAAKALM SAFYTFRYPLSLSPDDCRGVQH-LYGQPWPTVTSRTPALGPQAGIDTNEIAPLEPDAPPD-ACEASFDAVSTIR GELFFFKAGFVWRLRGGQLQPGY-PALASRHWQGLPSPVDAAFEDAQGHIWFFQG corresponding to amino acids 165-359 of MM11_HUMAN (SEQ ID NO:1455), which also corresponds to amino acids 165-359 of HSSTROL3_P7 (SEQ ID NO:1396), and a third amino acid sequence being at least 70%, optionally at least 80%, preferably at least 85%, more preferably at least 90% and most preferably at least 95% homologous to a polypeptide having the sequence TTGVSTPAPGV (SEQ ID NO: 253) corresponding to amino acids 360-370 of HSSTROL3_P7 (SEQ ID NO:1396), wherein said first amino acid sequence, bridging amino acid, second amino acid sequence and third amino acid sequence are contiguous and in a sequential order.

2. An isolated polypeptide encoding for a tail of HSSTROL3_P7 (SEQ ID NO:1396), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P7 (SEQ ID NO:1396).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P7 (SEQ ID NO:1396) also has the following non-silent SNPs (Single Nucleotide Polymorphisms) as listed in Table 1044, (given according to their position(s) on the amino acid sequence, with the alternative amino acid(s) listed; the last column indicates whether the SNP is known or not; the presence of known SNPs in variant protein HSSTROL3_P7 (SEQ ID NO:1396) sequence provides support for the deduced sequence of this variant protein according to the present invention).

TABLE 1044

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |
| 323 | Q -> H | Yes |

Variant protein HSSTROL3_P7 (SEQ ID NO:1396) is encoded by the following transcript(s): HSSTROL3_T10 (SEQ ID NO:128), for which the sequence(s) is/are given at the end of the application. The coding portion of transcript HSSTROL3_T10 (SEQ ID NO:128) is shown in bold; this coding portion starts at position 24 and ends at position 1133. The transcript also has the following SNPs as listed in Table 1045 (given according to their position on the nucleotide sequence, with the alternative nucleic acid listed; the last column indicates whether the SNP is known or not; the presence of known SNPs in variant protein HSSTROL3_P7 (SEQ ID NO:1396) sequence provides support for the deduced sequence of this variant protein according to the present invention).

TABLE 1045

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1386 | A -> G | Yes |

TABLE 1045-continued

Nucleic acid SNPs

| SNP position on nucleotide sequence | Alternative nucleic acid | Previously known SNP? |
|---|---|---|
| 1568 | A -> G | Yes |
| 2109 | A -> G | Yes |
| 2250 | C -> | No |
| 2302 | C -> A | Yes |
| 2328 | A -> T | Yes |
| 2545 | -> G | No |
| 2554 | -> G | No |
| 2568 | C -> | No |
| 2587 | -> A | No |
| 2613 | T -> C | No |
| 2671 | A -> | No |
| 2671 | A -> C | No |
| 2821 | A -> | No |
| 2821 | A -> C | No |
| 2851 | T -> C | Yes |
| 2998 | -> T | No |

Variant protein HSSTROL3_P8 (SEQ ID NO:1397) according to the present invention has an amino acid sequence as given at the end of the application; it is encoded by transcript(s) HSSTROL3_T11 (SEQ ID NO:129). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison report between HSSTROL3_P8 (SEQ ID NO:1397) and MM11_HUMAN (SEQ ID NO:1455)

1. An isolated chimeric polypeptide encoding for HSSTROL3_P8 (SEQ ID NO:1397), comprising a first amino acid sequence being at least 90% homologous to MAPAAWLRSAAARALLPPMLLLLLQPPPLLARAL-PPDVHHLHAERRGPQPWHAALPSSPAPAPATQEAPR PASSLRPPRCGVPDPSDGLSARNRQKRFVLSGGRW-EKTDLTYRILRFPWQLVQEQVRQTMAEALKVWSD VTPLTFTEVHEGRADIMIDFARYW corresponding to amino acids 1-163 of MM11_HUMAN (SEQ ID NO:1455), which also corresponds to amino acids 1-163 of HSSTROL3_P8 (SEQ ID NO:1397), a bridging amino acid H corresponding to amino acid 164 of HSSTROL3_P8 (SEQ ID NO:1397), a second amino acid sequence being at least 90% homologous to GDDLPFDGPGGILAHAFFPKTHREGD-VHFDYDETWTIGDDQGTDLLQVAAHEF-GHVLGLQHTTAAKALM SAFYTFRYPLSLSPD-DCRGVQHLYGQPWPTVTSRTPALGPQAGIDTNEIAPLE corresponding to amino acids 165-286 of MM11_HUMAN (SEQ ID NO:1455), which also corresponds to amino acids 165-286 of HSSTROL3_P8 (SEQ ID NO:1397), and a third amino acid sequence being at least 70%, optionally at least 80%, preferably at least 85%, more preferably at least 90% and most preferably at least 95% homologous to a polypeptide having the sequence VRPCLPVPLLLCWPL (SEQ ID NO: 254) corresponding to amino acids 287-301 of HSSTROL3_P8 (SEQ ID NO:1397), wherein said first amino acid sequence, bridging amino acid, second amino acid sequence and third amino acid sequence are contiguous and in a sequential order.

2. An isolated polypeptide encoding for a tail of HSSTROL3_P8 (SEQ ID NO:1397), comprising a polypeptide being at least 70%, optionally at least about 80%, preferably at least about 85%, more preferably at least about 90% and most preferably at least about 95% homologous to the sequence VRPCLPVPLLLCWPL (SEQ ID NO: 254) in HSSTROL3_P8 (SEQ ID NO:1397).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P8 (SEQ ID NO:1397) also has the following non-silent SNPs (Single Nucleotide Polymorphisms) as listed in Table 1046, (given according to their position(s) on the amino acid sequence, with the alternative amino acid(s) listed; the last column indicates whether the SNP is known or not; the presence of known SNPs in variant protein HSSTROL3_P8 (SEQ ID NO:1397) sequence provides support for the deduced sequence of this variant protein according to the present invention).

TABLE 1046

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |

Variant protein HSSTROL3_P8 (SEQ ID NO:1397) is encoded by the following transcript(s): HSSTROL3_T11 (SEQ ID NO:129), for which the sequence(s) is/are given at the end of the application. The coding portion of transcript HSSTROL3_T11 (SEQ ID NO:129) is shown in bold; this coding portion starts at position 24 and ends at position 926. The transcript also has the following SNPs as listed in Table 1047 (given according to their position on the nucleotide sequence, with the alternative nucleic acid listed; the last column indicates whether the SNP is known or not; the presence of known SNPs in variant protein HSSTROL3_P8 (SEQ ID NO:1397) sequence provides support for the deduced sequence of this variant protein according to the present invention).

TABLE 1047

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 935 | G -> A | Yes |
| 948 | G -> A | Yes |
| 1084 | G -> C | Yes |
| 1557 | C -> | No |
| 1609 | C -> A | Yes |
| 1635 | A -> T | Yes |
| 1852 | -> G | No |
| 1861 | -> G | No |
| 1875 | C -> | No |

TABLE 1047-continued

Nucleic acid SNPs

| SNP position on nucleotide sequence | Alternative nucleic acid | Previously known SNP? |
|---|---|---|
| 1894 | -> A | No |
| 1920 | T -> C | No |
| 1978 | A -> | No |
| 1978 | A -> C | No |
| 2128 | A -> | No |
| 2128 | A -> C | No |
| 2158 | T -> C | Yes |
| 2305 | -> T | No |

Variant protein HSSTROL3_P9 (SEQ ID NO:1398) according to the present invention has an amino acid sequence as given at the end of the application; it is encoded by transcript(s) HSSTROL3_T12 (SEQ ID NO:130). An alignment is given to the known protein (Stromelysin-3 precursor (SEQ ID NO:1455)) at the end of the application. One or more alignments to one or more previously published protein sequences are given at the end of the application. A brief description of the relationship of the variant protein according to the present invention to each such aligned protein is as follows:

Comparison report between HSSTROL3_P9 (SEQ ID NO:1398) and MM11_HUMAN (SEQ ID NO:1455)

1. An isolated chimeric polypeptide encoding for HSSTROL3_P9 (SEQ ID NO:1398), comprising a first amino acid sequence being at least 90% homologous to MAPAAWLRSAAARALLPPMLLLLLQPPPLLARALP-PDVHHLHAERRGPQPWHAALPSSPAPAPATQEAPR PASSLRPPRCGVPDPSDGLSARNRQK corresponding to amino acids 1-96 of MM11_HUMAN (SEQ ID NO:1455), which also corresponds to amino acids 1-96 of HSSTROL3_P9 (SEQ ID NO:1398), a second amino acid sequence being at least 90% homologous to RILRFP-WQLVQEQVRQTMAEALKVWSDVTPLT-FTEVHEGRADIMIDFARYW corresponding to amino acids 113-163 of MM11_HUMAN (SEQ ID NO:1455), which also corresponds to amino acids 97-147 of HSSTROL3_P9 (SEQ ID NO:1398), a bridging amino acid H corresponding to amino acid 148 of HSSTROL3_P9 (SEQ ID NO:1398), a third amino acid sequence being at least 90% homologous to GDDLPFDGPGGILAHAFFPKTHREGD-VHFDYDETWTIGDDQGTDLLQVAAHEF-GHVLGLQHTTAAKALM SAFYTFRYPLSLSPD-DCRGVQHLYGQPWPTVTSRTPALGPQAGIDTNEIAPL-EPDAPPDACEASFDAVSTIR GELFFFKAGFVWRLRG-GQLQPGYPALASRHWQGLPSPVDAAFEDAQ-GHIWFFQG corresponding to amino acids 165-359 of MM11_HUMAN (SEQ ID NO:1455), which also corresponds to amino acids 149-343 of HSSTROL3_P9 (SEQ ID NO:1398), and a fourth amino acid sequence being at least 70%, optionally at least 80%, preferably at least 85%, more preferably at least 90% and most preferably at least 95% homologous to a polypeptide having the sequence TTGVST-PAPGV (SEQ ID NO: 253) corresponding to amino acids 344-354 of HSSTROL3_P9 (SEQ ID NO:1398), wherein said first amino acid sequence, second amino acid sequence, bridging amino acid, third amino acid sequence and fourth amino acid sequence are contiguous and in a sequential order.

2. An isolated chimeric polypeptide encoding for an edge portion of HSSTROL3_P9 (SEQ ID NO:1398), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n−2)−x), in which x varies from 0 to n−2.

3. An isolated polypeptide encoding for a tail of HSSTROL3_P9 (SEQ ID NO:1398), comprising a polypeptide being at least 70%, optionally at least about 80%, preferably at least about 85%, more preferably at least about 90% and most preferably at least about 95% homologous to the sequence TTGVSTPAPGV (SEQ ID NO: 253) in HSSTROL3_P9 (SEQ ID NO:1398).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P9 (SEQ ID NO:1398) also has the following non-silent SNPs (Single Nucleotide Polymorphisms) as listed in Table 1048, (given according to their position(s) on the amino acid sequence, with the alternative amino acid(s) listed; the last column indicates whether the SNP is known or not; the presence of known SNPs in variant protein HSSTROL3_P9 (SEQ ID NO:1398) sequence provides support for the deduced sequence of this variant protein according to the present invention).

TABLE 1048

Amino acid mutations

| SNP position(s) on amino acid sequence | Alternative amino acid(s) | Previously known SNP? |
|---|---|---|
| 38 | V -> A | Yes |
| 198 | A -> | No |
| 307 | Q -> H | Yes |

Variant protein HSSTROL3_P9 (SEQ ID NO:1398) is encoded by the following transcript(s): HSSTROL3_T12 (SEQ ID NO:130), for which the sequence(s) is/are given at the end of the application. The coding portion of transcript HSSTROL3_T12 (SEQ ID NO:130) is shown in bold; this coding portion starts at position 24 and ends at position 1085. The transcript also has the following SNPs as listed in Table 1049 (given according to their position on the nucleotide sequence, with the alternative nucleic acid listed; the last column indicates whether the SNP is known or not; the presence of known SNPs in variant protein HSSTROL3_P9 (SEQ ID NO:1398) sequence provides support for the deduced sequence of this variant protein according to the present invention).

TABLE 1049

Nucleic acid SNPs

| SNP position on nucleotide sequence | Alternative nucleic acid | Previously known SNP? |
|---|---|---|
| 136 | T -> C | Yes |
| 615 | G -> | No |
| 651 | -> T | No |
| 944 | G -> C | Yes |
| 1275 | C -> | No |
| 1327 | C -> A | Yes |
| 1353 | A -> T | Yes |
| 1570 | -> G | No |
| 1579 | -> G | No |
| 1593 | C -> | No |
| 1612 | -> A | No |
| 1638 | T -> C | No |
| 1696 | A -> | No |
| 1696 | A -> C | No |
| 1846 | A -> | No |
| 1846 | A -> C | No |
| 1876 | T -> C | Yes |
| 2023 | -> T | No |

As noted above, cluster HSSTROL3 features 16 segment(s), which were listed in Table 1035 above and for which the sequence(s) are given at the end of the application. These segment(s) are portions of nucleic acid sequence(s) which are described herein separately because they are of particular interest. A description of each segment according to the present invention is now provided.

Segment cluster HSSTROL3_node_6 (SEQ ID NO:887) according to the present invention is supported by 14 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1050 below describes the starting and ending position of this segment on each transcript.

TABLE 1050

Segment location on transcripts

| Transcript name | Segment starting position | Segment ending position |
|---|---|---|
| HSSTROL3_T5 (SEQ ID NO:125) | 1 | 131 |
| HSSTROL3_T8 (SEQ ID NO:126) | 1 | 131 |
| HSSTROL3_T9 (SEQ ID NO:127) | 1 | 131 |
| HSSTROL3_T10 (SEQ ID NO:128) | 1 | 131 |
| HSSTROL3_T11 (SEQ ID NO:129) | 1 | 131 |
| HSSTROL3_T12 (SEQ ID NO:130) | 1 | 131 |

Segment cluster HSSTROL3_node_10 (SEQ ID NO:888) according to the present invention is supported by 21 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1051 below describes the starting and ending position of this segment on each transcript.

TABLE 1051

Segment location on transcripts

| Transcript name | Segment starting position | Segment ending position |
|---|---|---|
| HSSTROL3_T5 (SEQ ID NO:125) | 132 | 313 |
| HSSTROL3_T8 (SEQ ID NO:126) | 132 | 313 |
| HSSTROL3_T9 (SEQ ID NO:127) | 132 | 313 |
| HSSTROL3_T10 (SEQ ID NO:128) | 132 | 313 |
| HSSTROL3_T11 (SEQ ID NO:129) | 132 | 313 |
| HSSTROL3_T12 (SEQ ID NO:130) | 132 | 313 |

Segment cluster HSSTROL3_node_13 (SEQ ID NO:889) according to the present invention is supported by 36 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1052 below describes the starting and ending position of this segment on each transcript.

TABLE 1052

Segment location on transcripts

| Transcript name | Segment starting position | Segment ending position |
|---|---|---|
| HSSTROL3_T5 (SEQ ID NO:125) | 362 | 505 |
| HSSTROL3_T8 (SEQ ID NO:126) | 362 | 505 |
| HSSTROL3_T9 (SEQ ID NO:127) | 362 | 505 |
| HSSTROL3_T10 (SEQ ID NO:128) | 362 | 505 |
| HSSTROL3_T11 (SEQ ID NO:129) | 362 | 505 |
| HSSTROL3_T12 (SEQ ID NO:130) | 314 | 457 |

Segment cluster HSSTROL3_node_15 (SEQ ID NO:890) according to the present invention is supported by 47 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T 10 (SEQ ID NO:128), HSSTROL3_T11 (SEQ ID NO:129) and HSSTROL3_T12 (SEQ ID NO:130). Table 1053 below describes the starting and ending position of this segment on each transcript.

TABLE 1053

Segment location on transcripts

| Transcript name | Segment starting position | Segment ending position |
|---|---|---|
| HSSTROL3_T5 (SEQ ID NO:125) | 506 | 639 |
| HSSTROL3_T8 (SEQ ID NO:126) | 506 | 639 |
| HSSTROL3_T9 (SEQ ID NO:127) | 506 | 639 |
| HSSTROL3_T10 (SEQ ID NO:128) | 506 | 639 |
| HSSTROL3_T11 (SEQ ID NO:129) | 506 | 639 |
| HSSTROL3_T12 (SEQ ID NO:130) | 458 | 591 |

Segment cluster HSSTROL3_node_19 (SEQ ID NO:891) according to the present invention is supported by 63 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3 T10 (SEQ ID NO:128), HSSTROL3_T11 (SEQ ID NO:129) and HSSTROL3_T12

(SEQ ID NO:130). Table 1054 below describes the starting and ending position of this segment on each transcript.

TABLE 1054

Segment location on transcripts

| Transcript name | Segment starting position | Segment ending position |
|---|---|---|
| HSSTROL3_T5 (SEQ ID NO:125) | 699 | 881 |
| HSSTROL3_T8 (SEQ ID NO:126) | 699 | 881 |
| HSSTROL3_T9 (SEQ ID NO:127) | 699 | 881 |
| HSSTROL3_T10 (SEQ ID NO:128) | 699 | 881 |
| HSSTROL3_T11 (SEQ ID NO:129) | 699 | 881 |
| HSSTROL3_T12 (SEQ ID NO:130) | 651 | 883 |

Segment cluster HSSTROL3_node__21 (SEQ ID NO:892) according to the present invention is supported by 61 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1055 below describes the starting and ending position of this segment on each transcript.

TABLE 1055

Segment location on transcripts

| Transcript name | Segment starting position | Segment ending position |
|---|---|---|
| HSSTROL3_T5 (SEQ ID NO:125) | 882 | 1098 |
| HSSTROL3_T8 (SEQ ID NO:126) | 882 | 1098 |
| HSSTROL3_T9 (SEQ ID NO:127) | 882 | 1098 |
| HSSTROL3_T10 (SEQ ID NO:128) | 882 | 1098 |
| HSSTROL3_T11 (SEQ ID NO:129) | 974 | 1190 |
| HSSTROL3_T12 (SEQ ID NO:130) | 834 | 1050 |

Segment cluster HSSTROL3_node__24 (SEQ ID NO:893) according to the present invention is supported by 7 libraries. The number of libraries was determined as previously described. This segment can be found in the following transcript(s): HSSTROL3_T8 (SEQ ID NO:126) and HSSTROL3_T9 (SEQ ID NO:127). Table 1056 below describes the starting and ending position of this segment on each transcript.

TABLE 1056

Segment location on transcripts

| Transcript name | Segment starting position | Segment ending position |
|---|---|---|
| HSSTROL3_T8 (SEQ ID NO:125) | 1099 | 1236 |
| HSSTROL3_T9 (SEQ ID NO:126) | 1099 | 1236 |

Segment cluster HSSTROL3_node__25 (SEQ ID NO:894) according to the present invention is supported by 13 libraries. The number of libraries was determined as previously described. This segment can be found in the following transcript(s): HSSTROL3_T8 (SEQ ID NO:126). Table 1057 below describes the starting and ending position of this segment on each transcript.

TABLE 1057

Segment location on transcripts

| Transcript name | Segment starting position | Segment ending position |
|---|---|---|
| HSSTROL3_T8 (SEQ ID NO:126) | 1237 | 1536 |

Segment cluster HSSTROL3_node__26 (SEQ ID NO:895) according to the present invention is supported by 55 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127) and HSSTROL3_T11 (SEQ ID NO:129). Table 1058 below describes the starting and ending position of this segment on each transcript.

TABLE 1058

Segment location on transcripts

| Transcript name | Segment starting position | Segment ending position |
|---|---|---|
| HSSTROL3_T5 (SEQ ID NO:125) | 1099 | 1240 |
| HSSTROL3_T8 (SEQ ID NO:126) | 1537 | 1678 |
| HSSTROL3_T9 (SEQ ID NO:127) | 1237 | 1378 |
| HSSTROL3_T11 (SEQ ID NO:129) | 1191 | 1332 |

Segment cluster HSSTROL3_node__28 (SEQ ID NO:896) according to the present invention is supported by 10 libraries. The number of libraries was determined as previously described. This segment can be found in the following transcript(s): HSSTROL3_T5 (SEQ ID NO:125), HSSTROL3_T9 (SEQ ID NO:127) and HSSTROL3_T10 (SEQ ID NO:128). Table 1059 below describes the starting and ending position of this segment on each transcript.

TABLE 1059

Segment location on transcripts

| Transcript name | Segment starting position | Segment ending position |
|---|---|---|
| HSSTROL3_T5 (SEQ ID NO:125) | 1357 | 2283 |
| HSSTROL3_T9 (SEQ ID NO:127) | 1495 | 2421 |
| HSSTROL3_T10 (SEQ ID NO:128) | 1215 | 2141 |

Segment cluster HSSTROL3_node__29 (SEQ ID NO:897) according to the present invention is supported by 109 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1060 below describes the starting and ending position of this segment on each transcript.

TABLE 1060

Segment location on transcripts

| Transcript name | Segment starting position | Segment ending position |
|---|---|---|
| HSSTROL3_T5 (SEQ ID NO:125) | 2284 | 3194 |
| HSSTROL3_T8 (SEQ ID NO:126) | 1795 | 2705 |

TABLE 1060-continued

Segment location on transcripts

| Transcript name | Segment starting position | Segment ending position |
|---|---|---|
| HSSTROL3_T9 (SEQ ID NO:127) | 2422 | 3332 |
| HSSTROL3_T10 (SEQ ID NO:128) | 2142 | 3052 |
| HSSTROL3_T11 (SEQ ID NO:129) | 1449 | 2359 |
| HSSTROL3_T12 (SEQ ID NO:130) | 1167 | 2077 |

According to an optional embodiment of the present invention, short segments related to the above cluster are also provided. These segments are up to about 120 bp in length, and so are included in a separate description.

Segment cluster HSSTROL3_node_11 (SEQ ID NO:898) according to the present invention is supported by 25 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128) and HSSTROL3_T11 (SEQ ID NO:129). Table 1061 below describes the starting and ending position of this segment on each transcript.

TABLE 1061

Segment location on transcripts

| Transcript name | Segment starting position | Segment ending position |
|---|---|---|
| HSSTROL3_T5 (SEQ ID NO:125) | 314 | 361 |
| HSSTROL3_T8 (SEQ ID NO:126) | 314 | 361 |
| HSSTROL3_T9 (SEQ ID NO:127) | 314 | 361 |
| HSSTROL3_T10 (SEQ ID NO:128) | 314 | 361 |
| HSSTROL3_T11 (SEQ ID NO:129) | 314 | 361 |

Segment cluster HSSTROL3_node_17 (SEQ ID NO:899) according to the present invention is supported by 45 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1062 below describes the starting and ending position of this segment on each transcript.

TABLE 1062

Segment location on transcripts

| Transcript name | Segment starting position | Segment ending position |
|---|---|---|
| HSSTROL3_T5 (SEQ ID NO:125) | 640 | 680 |
| HSSTROL3_T8 (SEQ ID NO:126) | 640 | 680 |
| HSSTROL3_T9 (SEQ ID NO:127) | 640 | 680 |
| HSSTROL3_T10 (SEQ ID NO:128) | 640 | 680 |
| HSSTROL3_T11 (SEQ ID NO:129) | 640 | 680 |
| HSSTROL3_T12 (SEQ ID NO:130) | 592 | 632 |

Segment cluster HSSTROL3_node_8 (SEQ ID NO:900) according to the present invention can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1063 below describes the starting and ending position of this segment on each transcript.

TABLE 1063

Segment location on transcripts

| Transcript name | Segment starting position | Segment ending position |
|---|---|---|
| HSSTROL3_T5 (SEQ ID NO:125) | 681 | 698 |
| HSSTROL3_T8 (SEQ ID NO:126) | 681 | 698 |
| HSSTROL3_T9 (SEQ ID NO:127) | 681 | 698 |
| HSSTROL3_T10 (SEQ ID NO:128) | 681 | 698 |
| HSSTROL3_T11 (SEQ ID NO:129) | 681 | 698 |
| HSSTROL3_T12 (SEQ ID NO:130) | 633 | 650 |

Segment cluster HSSTROL3_node_20 (SEQ ID NO:901) according to the present invention is supported by 1 libraries. The number of libraries was determined as previously described. This segment can be found in the following transcript(s): HSSTROL3_T11 (SEQ ID NO:129). Table 1064 below describes the starting and ending position of this segment on each transcript.

TABLE 1064

Segment location on transcripts

| Transcript name | Segment starting position | Segment ending position |
|---|---|---|
| HSSTROL3_T11 (SEQ ID NO:129) | 882 | 973 |

Segment cluster HSSTROL3_node_27 (SEQ ID NO:902) according to the present invention is supported by 50 libraries. The number of libraries was determined as previously described. This segment can be found in the following transcript(s): HSSTROL3_T5 (SEQ ID NO:125), HSSTROL3_T8 (SEQ ID NO:126), HSSTROL3_T9 (SEQ ID NO:127), HSSTROL3_T10 (SEQ ID NO:128), HSSTROL3_T11 (SEQ ID NO:129) and HSSTROL3_T12 (SEQ ID NO:130). Table 1065 below describes the starting and ending position of this segment on each transcript.

TABLE 1065

Segment location on transcripts

| Transcript name | Segment starting position | Segment ending position |
|---|---|---|
| HSSTROL3_T5 (SEQ ID NO:125) | 1241 | 1356 |
| HSSTROL3_T8 (SEQ ID NO:126) | 1679 | 1794 |
| HSSTROL3_T9 (SEQ ID NO:127) | 1379 | 1494 |
| HSSTROL3_T10 (SEQ ID NO:128) | 1099 | 1214 |
| HSSTROL3_T11 (SEQ ID NO:129) | 1333 | 1448 |
| HSSTROL3_T12 (SEQ ID NO:130) | 1051 | 1166 |

Variant protein alignment to the previously known protein:

Sequence name: MM11_HUMAN (SEQ ID NO:1455)

Sequence documentation:

Alignment of: HSSTROL3_P4 (SEQ ID NO:1394) x MM11_HUMAN (SEQ ID NO:1455)

Alignment segment 1/1:

| Quality: | 4444.00 | Escore: | 0 |
|---|---|---|---|
| Matching length: | 445 | Total length: | 445 |
| Matching Percent Similarity: | 99.78 | Matching Percent Identity: | 99.78 |
| Total Percent Similarity: | 99.78 | Total Percent Identity: | 99.78 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKRFVL 100
    ||||||||||||||||||||||||||||||||||||||||||||||||||
 51 WHAALPSSPAPAPATQEAPRPASSLRPPRCGVPDPSDGLSARNRQKRFVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    |||||||||||||| |||||||||||||||||||||||||||||||||||
151 GRADIMIDFARYWDGDDLPFDGPGGILAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    ||||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    ||||||||||||||||||||||||||||||||||||||||||||||||||
301 VSTIRGELFFFKAGFVWRLRGGQLQPGYPALASRHWQGLPSPVDAAFEDA 350

351 QGHIWFFQGAQYWVYDGEKPVLGPAPLTELGLVRFPVHAALVWGPEKNKI 400
    ||||||||||||||||||||||||||||||||||||||||||||||||||
351 QGHIWFFQGAQYWVYDGEKPVLGPAPLTELGLVRFPVHAALVWGPEKNKI 400

401 YFFRGRDYWRFHPSTRRVDSPVPRRATDWRGVPSEIDAAFQDADG      445
    |||||||||||||||||||||||||||||||||||||||||||||
401 YFFRGRDYWRFHPSTRRVDSPVPRRATDWRGVPSEIDAAFQDADG      445
```

Sequence name: MM11_HUMAN (SEQ ID NO:1455)

Sequence documentation:

Alignment of: HSSTROL3_P5 (SEQ ID NO:1395) x MM11_HUMAN (SEQ ID NO:1455)

Alignment segment 1/1:

| Quality: | 3566.00 | Escore: | 0 |
|---|---|---|---|
| Matching length: | 358 | Total length: | 358 |
| Matching Percent Similarity: | 99.72 | Matching Percent Identity: | 99.72 |
| Total Percent Similarity: | 99.72 | Total Percent Identity: | 99.72 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKRFVL 100
    ||||||||||||||||||||||||||||||||||||||||||||||||||
 51 WHAALPSSPAPAPATQEAPRPASSLRPPRCGVPDPSDGLSARNRQKRFVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    ||||||||||||||| ||||||||||||||||||||||||||||||||||
151 GRADIMIDFARYWDGDDLPFDGPGGILAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    ||||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    ||||||||||||||||||||||||||||||||||||||||||||||||||
301 VSTIRGELFFFKAGFVWRLRGGQLQPGYPALASRHWQGLPSPVDAAFEDA 350

351 QGHIWFFQ                                          358
    ||||||||
351 QGHIWFFQ                                          358
```

Sequence name: MM11_HUMAN (SEQ ID NO:1455)

Sequence documentation:

Alignment of: HSSTROL3_P7 (SEQ ID NO:1396) x MM11_HUMAN (SEQ ID NO:1455)

Alignment segment 1/1:

| | | | |
|---|---|---|---|
| Quality: | 3575.00 | Escore: | 0 |
| Matching length: | 359 | Total length: | 359 |
| Matching Percent Similarity: | 99.72 | Matching Percent Identity: | 99.72 |
| Total Percent Similarity: | 99.72 | Total Percent Identity: | 99.72 |
| Gaps: | 0 | | |

Alignment:

```
  1 MAPAAWLRSAAARALLPPMLLLLLQPPPLLARALPPDVHHLHAERRGPQP  50
    |||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKRFVL 100
    |||||||||||||||||||||||||||||||||||||||||||||||||
 51 WHAALPSSPAPAPATQEAPRPASSLRPPRCGVPDPSDGLSARNRQKRFVL 100

101 SGGRWEKTDLTYRILRFPWQLVQEQVRQTMAEALKVWSDVTPLTFTEVHE 150
    |||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    ||||||||||||||| |||||||||||||||||||||||||||||||||
151 GRADIMIDFARYWDGDDLPFDGPGGILAHAFFPKTHREGDVHFDYDETWT 200

201 IGDDQGTDLLQVAAHEFGHVLGLQHTTAAKALMSAFYTFRYPLSLSPDDC 250
    |||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLEPDAPPDACEASFDA 300
    |||||||||||||||||||||||||||||||||||||||||||||||||
251 RGVQHLYGQPWPTVTSRTPALGPQAGIDTNEIAPLEPDAPPDACEASFDA 300

301 VSTIRGELFFFKAGFVWRLRGGQLQPGYPALASRHWQGLPSPVDAAFEDA 350
    |||||||||||||||||||||||||||||||||||||||||||||||||
301 VSTIRGELFFFKAGFVWRLRGGQLQPGYPALASRHWQGLPSPVDAAFEDA 350

351 QGHIWFFQG                                         359
    |||||||||
351 QGHIWFFQG                                         359
```

Sequence name: MM11_HUMAN (SEQ ID NO:1455)

Sequence documentation:

Alignment of: HSSTROL3_P8 (SEQ ID NO:1397) x MM11_HUMAN (SEQ ID NO:1455)

Alignment segment 1/1:

| | | | |
|---|---|---|---|
| Quality: | 2838.00 | Escore: | 0 |
| Matching length: | 286 | Total length: | 286 |
| Matching Percent Similarity: | 99.65 | Matching Percent Identity: | 99.65 |
| Total Percent Similarity: | 99.65 | Total Percent Identity: | 99.65 |
| Gaps: | 0 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQKRFVL 100
    ||||||||||||||||||||||||||||||||||||||||||||||||||
 51 WHAALPSSPAPAPATQEAPRPASSLRPPRCGVPDPSDGLSARNRQKRFVL 100

101 SGGRWEKTDLTYRILRFPWQLVQEQVRQTMAEALKVWSDVTPLTFTEVHE 150
    ||||||||||||||||||||||||||||||||||||||||||||||||||
101 SGGRWEKTDLTYRILRFPWQLVQEQVRQTMAEALKVWSDVTPLTFTEVHE 150

151 GRADIMIDFARYWHGDDLPFDGPGGILAHAFFPKTHREGDVHFDYDETWT 200
    ||||||||||||| |||||||||||||||||||||||||||||||||||
151 GRADIMIDFARYWDGDDLPFDGPGGILAHAFFPKTHREGDVHFDYDETWT 200

201 IGDDQGTDLLQVAAHEFGHVLGLQHTTAAKALMSAFYTFRYPLSLSPDDC 250
    ||||||||||||||||||||||||||||||||||||||||||||||||||
201 IGDDQGTDLLQVAAHEFGHVLGLQHTTAAKALMSAFYTFRYPLSLSPDDC 250

251 RGVQHLYGQPWPTVTSRTPALGPQAGIDTNEIAPLE              286
    ||||||||||||||||||||||||||||||||||||
251 RGVQHLYGQPWPTVTSRTPALGPQAGIDTNEIAPLE              286
```

Sequence name: MM11HUMAN (SEQ ID NO:1455)

Sequence documentation:

Alignment of: HSSTROL3_P9 (SEQ ID NO:1398) x MM11_HUMAN (SEQ ID NO:1455)

Alignment segment 1/1:

| | | | |
|---|---|---|---|
| Quality: | 3316.00 | Escore: | 0 |
| Matching length: | 343 | Total length: | 359 |
| Matching Percent Similarity: | 99.71 | Matching Percent Identity: | 99.71 |
| Total Percent Similarity: | 95.26 | Total Percent Identity: | 95.26 |
| Gaps: | 1 | | |

Alignment:

```
  1 MAPAAWLRSAAARALLPPMLLLLLQPPPLLARALPPDVHHLHAERRGPQP  50
    ||||||||||||||||||||||||||||||||||||||||||||||||||
  1 MAPAAWLRSAAARALLPPMLLLLLQPPPLLARALPPDVHHLHAERRGPQP  50

51 WHAALPSSPAPAPATQEAPRPASSLRPPRCGVPDPSDGLSARNRQK....  96
    |||||||||||||||||||||||||||||||||||||||||||||
 51 WHAALPSSPAPAPATQEAPRPASSLRPPRCGVPDPSDGLSARNRQKRFVL 100

97 ...........RILRFPWQLVQEQVRQTMAEALKVWSDVTPLTFTEVHE 134
               |||||||||||||||||||||||||||||||||||||
101 SGGRWEKTDLTYRILRFPWQLVQEQVRQTMAEALKVWSDVTPLTFTEVHE 150

135 GRADIMIDFARYWHGDDLPFDGPGGILAHAFFPKTHREGDVHFDYDETWT 184
    |||||||||||| |||||||||||||||||||||||||||||||||||
151 GRADIMIDFARYWDGDDLPFDGPGGILAHAFFPKTHREGDVHFDYDETWT 200

185 IGDDQGTDLLQVAAHEFGHVLGLQHTTAAKALMSAFYTFRYPLSLSPDDC 234
    |||||||||||||||||||||||||||||||||||||||||||||||||
201 IGDDQGTDLLQVAAHEFGHVLGLQHTTAAKALMSAFYTFRYPLSLSPDDC 250

235 RGVQHLYGQPWPTVTSRTPALGPQAGIDTNEIAPLEPDAPPDACEASFDA 284
    |||||||||||||||||||||||||||||||||||||||||||||||||
251 RGVQHLYGQPWPTVTSRTPALGPQAGIDTNEIAPLEPDAPPDACEASFDA 300

285 VSTIRGELFFFKAGFVWRLRGGQLQPGYPALASRHWQGLPSPVDAAFEDA 334
    |||||||||||||||||||||||||||||||||||||||||||||||||
301 VSTIRGELFFFKAGFVWRLRGGQLQPGYPALASRHWQGLPSPVDAAFEDA 350

335 QGHIWFFQG                                         343
    |||||||||
351 QGHIWFFQG                                         359
```

The data given below shows that HSSTROL3 splice variants of the present invention can be used as useful diagnostic agents for lung cancer. In particular, differential overexpression in lung cancer cells (as opposed to normal lung cells and normal tissue of other types) was demonstrated through determination of mRNA expression, while antibodies selective for HSSTROL3_P9 (SEQ ID NO:1398) splice variant were found to be capable of detecting HSSTROL3_P9 (SEQ ID NO:1398) splice variant in human serum (blood samples), further conforming the existence of HSSTROL3 P9 (SEQ ID NO:1398) splice variant protein. HSSTROL3 P9 (SEQ ID NO:1398) splice variant protein was found consistently to be present in one serum sample taken from a patient with a lung cancer and not in any other healthy subjects, suggesting a differential expression in serum samples derived from lung cancer patients as compared to healthy individuals, thereby supporting the utility of HSSTROL3_P9 (SEQ ID NO:1398) splice variant as a diagnostic agent for lung cancer.

Expression of Stromelysin-3 Precursor HSSTROL3 Transcripts which are Detectable by Amplicon as Depicted in Sequence Name HSSTROL3 seg24 (SEQ ID NO:1675) in Normal and Cancerous Lung Tissues Expression of Stromelysin-3 precursor (EC 3.4.24.-) (Matrix metalloproteinase-11) (MMP-11) (ST3) (SL-3) transcripts detectable by or according to seg24, HSSTROL3 seg24 amplicon (SEQ ID NO:1675) and HSSTROL3 seg24F (SEQ ID NO:1673) and HSSTROL3 seg24R (SEQ ID NO:1674) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 "Tissue samples in testing panel", above), to obtain a value of fold up-regulation for each sample relative to median of the normal PM samples.

Figure 39:
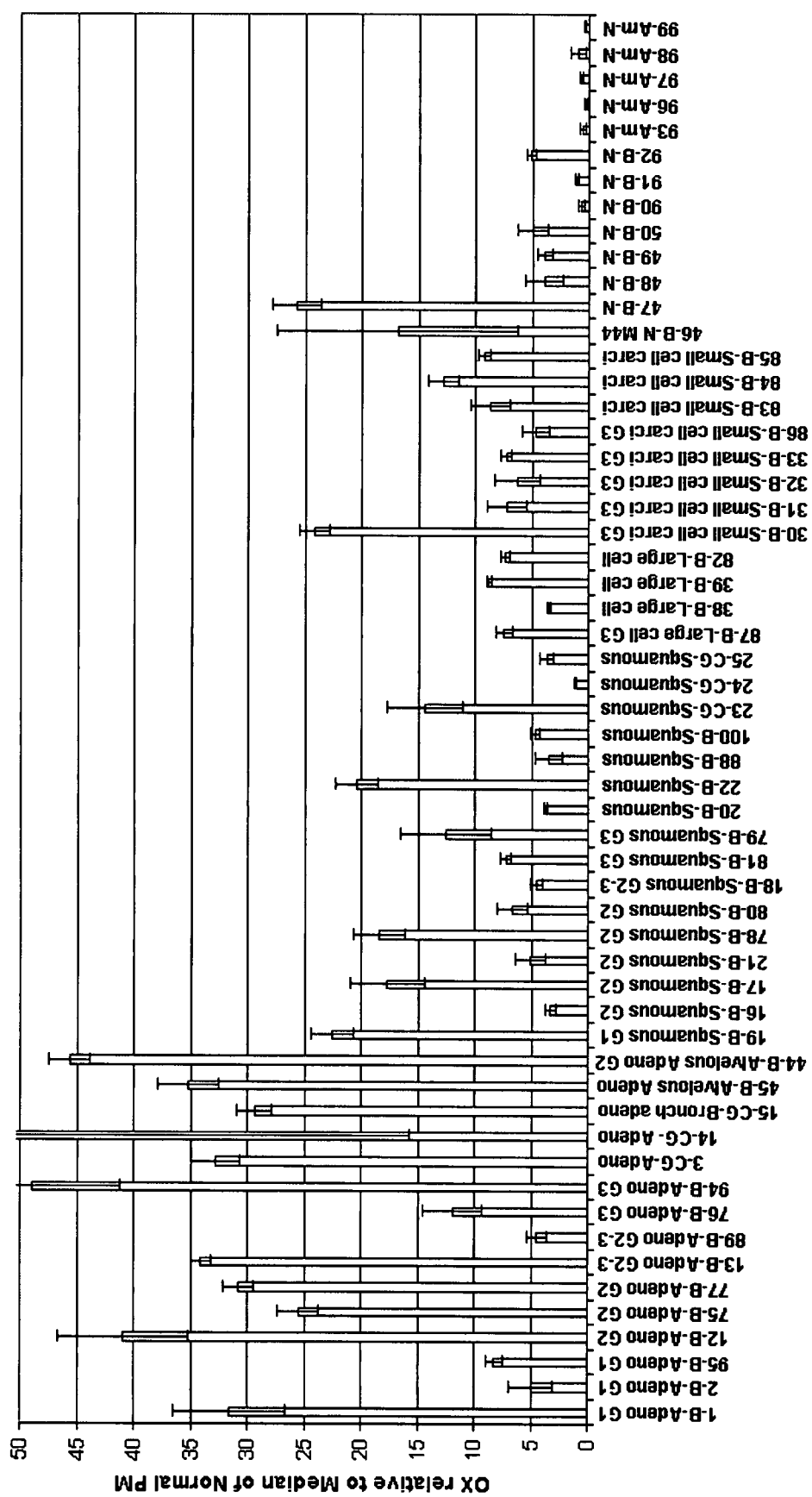
FIG. 39 is a histogram showing over expression of the Stromelysin-3 HSSTROL3 transcripts, which are detectable by amplicon as depicted in sequence name HSSTROL3 seg24 (SEQ ID NO:1675), in cancerous lung samples relative to the normal samples.

FIG. 39 is a histogram showing over expression of the above-indicated Stromelysin-3 precursor transcripts in cancerous lung samples relative to the normal samples. Values represent the average of duplicate experiments. Error bars indicate the minimal and maximal values obtained.)

As is evident from FIG. 39, the expression of Stromelysin-3 precursor transcripts detectable by the above amplicon(s) in cancer samples was significantly higher than in the non-cancerous samples (Sample Nos. 47-50, 90-93, 96-99 Table 2, "Tissue samples in testing panel"). Notably an over-expression of at least 5 fold was found in 13 out of 15 adenocarcinoma samples, 8 out of 16 squamous cell carcinoma samples, 3 out of 4 large cell carcinoma samples and in 7 out of 8 small cell carcinoma samples.

Threshold of 5 fold overexpression was found to differentiate between cancer and normal samples with P value of- 4.04E-04 in adenocarcinoma, 9.89E-02 in squamous cell carcinoma, 6.04E-02 in Large cell carcinoma, 3.14E-03 in small cell carcinoma as checked by exact fisher test. The above values demonstrate statistical significance of the results.

Primer pairs are also optionally and preferably encompassed within the present invention; for example, for the above experiment, the following primer pair was used as a non-limiting illustrative example only of a suitable primer pair: HSSTROL3 seg24F forward primer (SEQ ID NO: 1673); and HSSTROL3 seg24R reverse primer (SEQ ID NO: 1674).

The present invention also preferably encompasses any amplicon obtained through the use of any suitable primer pair; for example, for the above experiment, the following amplicon was obtained as a non-limiting illustrative example only of a suitable amplicon: HSSTROL3 seg24 (SEQ ID NO:1675).

Forward Primer (SEQ ID NO: 1673): ATTTCCATCCT-CAACTGGCAGA

Reverse Primer (SEQ ID NO: 1674): TGCCCTGGAAC-CCACG

Amplicon (SEQ ID NO: 1675): ATTTCCATCCT-CAACTGGCAGAGATGAGAGCCTGGAGCATTGCAG-ATGCCAGGGACTTCACAAATGA AGGCACAG-CATGGGAAACCTGCGTGGGTTCCAGGGCA Expression of Stromelysin-3 Precursor HSSTROL3
Transcripts which are Detectable by Amplicon as
Depicted in Sequence Name HSSTROL3 seg24
(SEQ ID NO:1675) in Different Normal Tissues Expression of Stromelysin-3 precursor transcripts detectable by or according to HSSTROL3 seg24 amplicon (SEQ ID NO:1675) and HSSTROL3 seg24F (SEQ ID NO:1673) and HSSTROL3 seg24R (SEQ ID NO: 1674) was measured by real time PCR. In parallel the expression of four housekeeping genes Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17, Table 2 "Tissue samples in normal panel", above), to obtain a value of relative expression of each sample relative to median of the lung samples.

Forward Primer (SEQ ID NO: 1673): ATTTCCATCCT-CAACTGGCAGA

Reverse Primer (SEQ ID NO: 1674): TGCCCTGGAAC-CCACG

Figure 40:
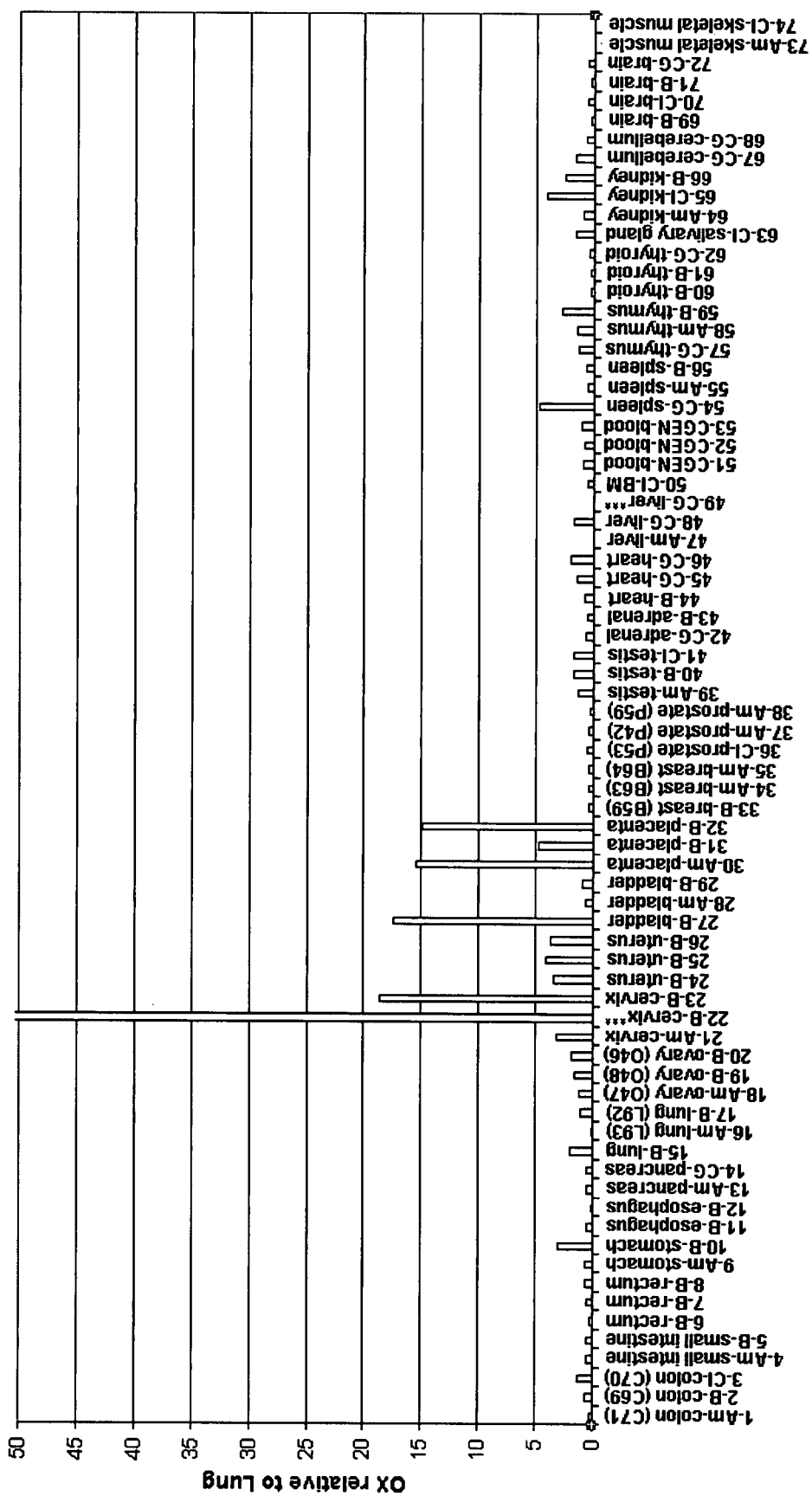
FIG. 40 is a histogram showing the expression of Stromelysin-3 HSSTROL3 transcripts, which are detectable by amplicon as depicted in sequence name HSSTROL3 seg24 (SEQ ID NO:1675), in different normal tissues.

Amplicon (SEQ ID NO: 1675): ATTTCCATCCT-CAACTGGCAGAGATGAGAGCCTGGAGCATTGCAG-ATGCCAGGGACTTCACAAATGA AGGCACAG-CATGGGAAACCTGCGTGGGTTCCAGGGCA The results are demonstrated in FIG. 40, showing the expression of Stromelysin-3 HSSTROL3 transcripts, which are detectable by amplicon as depicted in sequence name HSSTROL3 seg24 (SEQ ID NO: 1675), in different normal tissues.

Expression of Homo Sapiens Matrix
Metalloproteinase 11 (Stromelysin 3) (MMP11)
HSSTROL3 Transcripts which are Detectable by
Amplicon as Depicted in Sequence Name
HSSTROL3 seg20-21 (SEQ ID NO:1678) in normal
and Cancerous Lung Tissues Expression of Homo sapiens matrix metalloproteinase 11 (stromelysin 3) (MMP11) transcripts detectable by or according to seg20-21, HSSTROL3 seg20-21 amplicon (SEQ ID NO:1678) and primers HSSTROL3 seg20-21F (SEQ ID NO:1676) and HSSTROL3 seg20-21R (SEQ ID NO:1677) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 71:
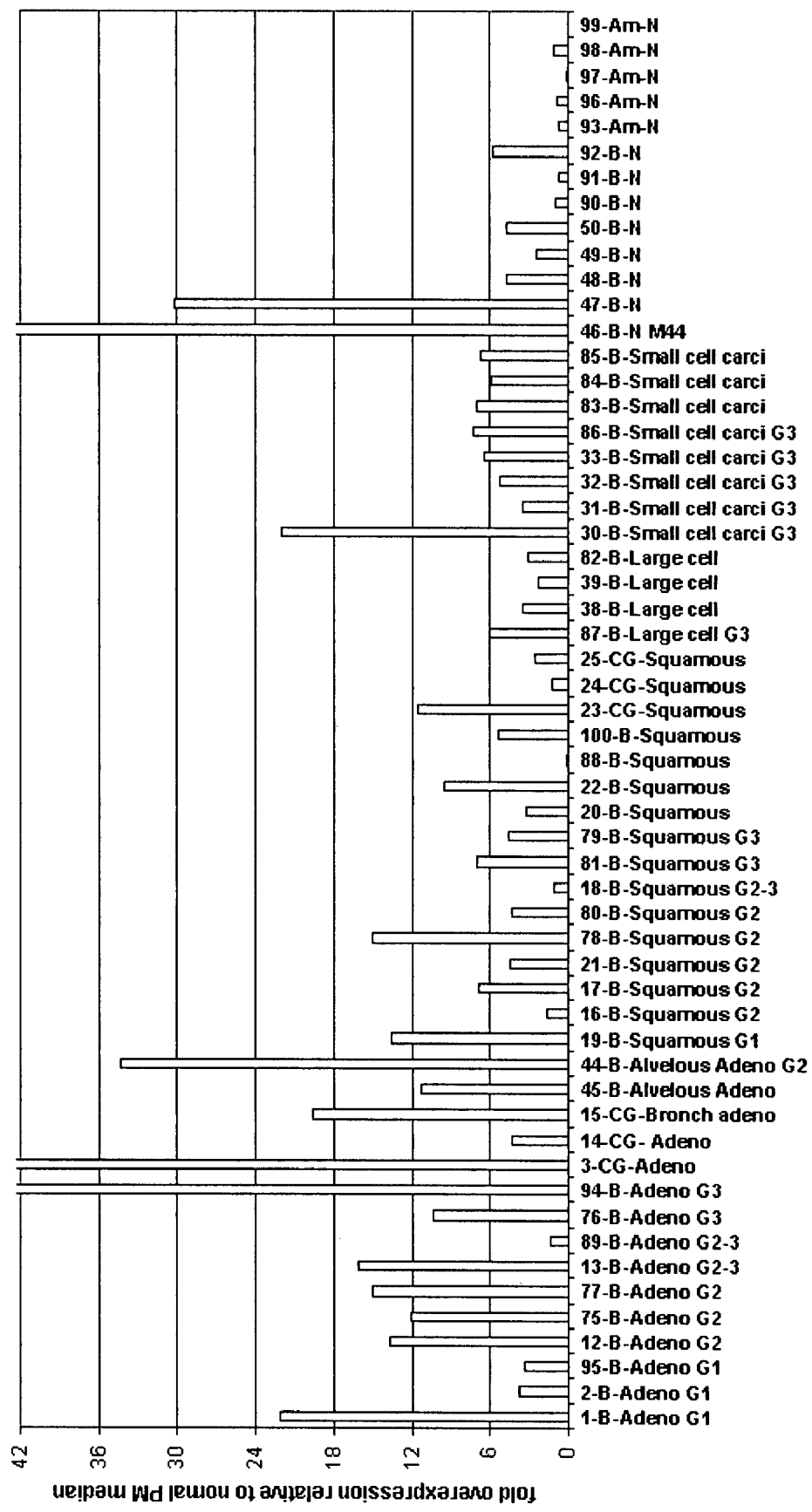
FIG. 71 is a histogram showing over expression of the Homo sapiens matrix metalloproteinase 11 (stromelysin 3) (MMP11) HSSTROL3 transcripts which are detectable by amplicon as depicted in sequence name HSSTROL3 seg20-2 (SEQ ID NO:1678) in cancerous lung samples relative to the normal samples.

FIG. 71 is a histogram showing over expression of the above-indicated Homo sapiens matrix metalloproteinase 11 (stromelysin 3) (MMP11) transcripts in cancerous lung samples relative to the normal samples.

As is evident from FIG. 71, the expression of Homo sapiens matrix metalloproteinase 11 (stromelysin 3) (MMP11) transcripts detectable by the above amplicon(s) in cancer samples was significantly higher than in the non-cancerous samples (Sample Nos. 46-50, 90-93, 96-99 Table 2,). Notably an over-expression of at least 6 fold was found in 11 out of 15 adenocarcinoma samples, 6 out of 16 squamous cell carcinoma samples, 1 out of 4 large cell carcinoma samples and in 6 out of 8 small cells carcinoma samples.

Primer pairs are also optionally and preferably encompassed within the present invention; for example, for the above experiment, the following primer pair was used as a non-limiting illustrative example only of a suitable primer pair: HSSTROL3 seg20-21F forward primer (SEQ ID NO: 1676); and HSSTROL3 seg20-21R reverse primer (SEQ ID NO: 1677).

The present invention also preferably encompasses any amplicon obtained through the use of any suitable primer pair; for example, for the above experiment, the following amplicon was obtained as a non-limiting illustrative example only of a suitable amplicon: HSSTROL3 seg20-21 (SEQ ID NO: 1678).

Forward primer HSSTROL3 seg20-21F (SEQ ID NO: 1676): TCTGCTGGCCACTGTGACTG

Reverse primer HSSTROL3 seg20-21R (SEQ ID NO: 1677): GAAGAAAAGAGCTCGCCTCG

Amplicon HSSTROL3 seg20-21 (SEQ ID NO: 1678): TCT-GCTGGCCACTGTGACTGCAGCATATGCCCTCAGC-ATGTGTCCCTCTCTCCCACCCCAGCCAGACG

CCCCGCCAGATGCCTGTGAGGCCTCCTTTGACGC-
GGTCTCCACCATCCGAGGCGAGCTCTTTTTTTCTTC

Expression of Homo Sapiens Matrix Metalloproteinase 11 (Stromelysin 3) (MMP11) HSSTROL3 Transcripts which are Detectable by Amplicon as Depicted in Sequence Name HSSTROL3junc21-27 (SEQ ID NO:1681) in Normal and Cancerous Lung Tissues Expression of *Homo sapiens* matrix metalloproteinase 11 (stromelysin 3) (MMP11) transcripts detectable by or according to junc21-27, HSSTROL3 junc21-27 amplicon (SEQ ID NO:1681) and primers HSSTROL3 junc21-27F (SEQ ID NO: 1679) and HSSTROL3 junc21-27R (SEQ ID NO: 1680) was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 72:
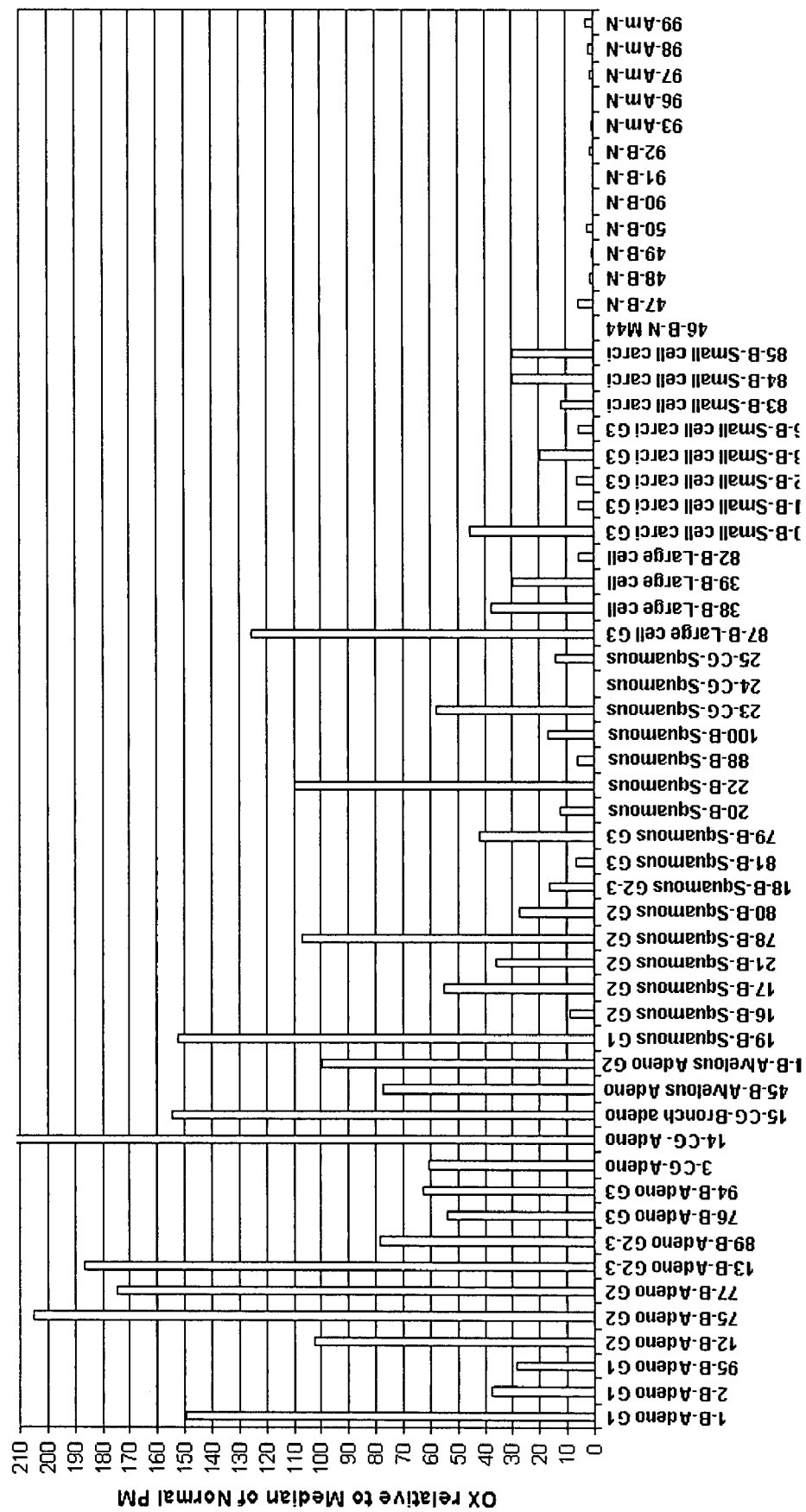
FIG. 72 is a histogram showing over expression of the Homo sapiens matrix metalloproteinase 11 (stromelysin 3) (MMP11) HSSTROL3 transcripts which are detectable by amplicon as depicted in sequence name HSSTROL3 junc21-27 (SEQ ID NO:1681) in cancerous lung samples relative to the normal samples.

FIG. 72 is a histogram showing over expression of the above-indicated *Homo sapiens* matrix metalloproteinase 11 (stromelysin 3) (MMP11) transcripts in cancerous lung samples relative to the normal samples.

As is evident from FIG. 72, the expression of *Homo sapiens* matrix metalloproteinase 11 (stromelysin 3) (MMP11) transcripts detectable by the above amplicon(s) in cancer samples was significantly higher than in the non-cancerous samples (Sample Nos. 46-50, 90-93, 96-99 Table 2,). Notably an over-expression of at least 10 fold was found in 15 out of 15 adenocarcinoma samples, 13 out of 16 squamous cell carcinoma samples, 3 out of 4 large cell carcinoma samples and in 5 out of 8 small cells carcinoma samples.

Primer pairs are also optionally and preferably encompassed within the present invention; for example, for the above experiment, the following primer pair was used as a non-limiting illustrative example only of a suitable primer pair: HSSTROL3 junc21-27F forward primer (SEQ ID NO: 1679); and HSSTROL3 junc21-27R reverse primer (SEQ ID NO: 1680).

The present invention also preferably encompasses any amplicon obtained through the use of any suitable primer pair; for example, for the above experiment, the following amplicon was obtained as a non-limiting illustrative example only of a suitable amplicon: HSSTROL3 junc21-27 (SEQ ID NO:1681).

Forward primer HSSTROL3 junc21-27F (SEQ ID NO: 1679): ACATTTGGTTCTTCCAAGGGACTAC

Reverse primer HSSTROL3 junc21-27R (SEQ ID NO: 1680): TCGATCTCAGAGGGCACCC

Amplicon HSSTROL3 junc21-27 (SEQ ID NO: 1681): ACATTTGGTTCTrCCAAGGGACTACTGGCGTTTCC-ACCCCAGCACCCGGCGTGTAGACAGTCCCGTGC CCCGCAGGGCCACTGACTGGAGAGGGGTGCCCTC-TGAGATCGA FIG. 72 is a histogram showing over expression of the *Homo sapiens* matrix metalloproteinase 11 (stromelysin 3) (MMP11) HSSTROL3 transcripts which are detectable by amplicon as depicted in sequence name HSSTROL3 junc21-27 (SEQ ID NO:1681) in cancerous lung samples relative to the normal samples. The transcript encoding for HSSTROL3_T12 splice variant (SEQ ID NO:130)) was shown to be specifically differentially overexpressed in lung cancer tissue samples. The junction HSSTROL3 junc21-27 (SEQ ID NO:1681) between two nodes is unique to this polynucleotide and hence shows that this protein would be predicted to be overexpressed in lung cancer. It should be noted for the sake of completeness that this junction is present also in one other sequence, HSSTROL3_T12 (SEQ ID NO:128); however, only SEQ ID NO:130 was verified as being expressed as a full length sequence. The full length mRNA identical to SEQ ID NO:130 was published (after the priority date of the present application) in GenBank with accession number AK075448 [gi:22761543].

1. HSSTROL3 P9 (SEQ ID NO:1398) Splice Variant is Detected in Serum Samples.

Antibodies were raised against peptides corresponding to HSSTROL3_P9 (SEQ ID NO:1398) splice variant. Antibodies raised against HSSTROL3_P9 (SEQ ID NO:1398) splice variant showed that HSSTROL3_P9 (SEQ ID NO:1398) splice variant protein was found consistently to be present in one serum sample taken from a patient with a small cell lung carcinoma and not in any other healthy subjects, suggesting a differential expression in serum samples derived from lung cancer patients as compared to healthy individuals, thereby supporting the utility of HSSTROL3_P9 (SEQ ID NO:1398) splice variant as a diagnostic agent for lung cancer. The experiments were performed as described in greater detail below.

As a tool for antibody development and ELISA assay development, both recombinant HSSTROL3_P9 (SEQ ID NO:1398) splice variant (MMP11_354) and wild type WT MMP11 (SEQ ID NO:1455) (MMP11_488) proteins were produced. The two genes were originally cloned into mammalian vectors, and then corresponding DNA fragments were transferred from the mammalian vectors into bacterial expression vectors. The protein was produced and purified from bacterial cells.

1.1 Cloning and Expression of HSSTROL3_P9 (SEQ ID NO:1398) and WT MMP11 (SEQ ID NO:1455).

1.1.1 Cloning of HSSTROL3_P9 (SEQ ID NO:1398) and WT MMP11 (SEQ ID NO:1455)

The following sequences were codon optimized to boost protein expression in mammalian system: the active domain of WT MMP11 (SEQ ID NO:1455) (amino acids 114-end, (SEQ ID NO:1782)), and the active domain of HSSTROL3_P9 (SEQ ID NO:1398) (amino acids 98-end, (SEQ ID NO:1783)). In addition, bacterial low usage codons were eliminated to enable bacterial expression of the variants using the same sequences.

The optimized genes were synthesized by GeneArt (Germany) by using their proprietary gene synthesis technology with the addition of DNA sequences encoding the His-tag downstream to the ectopic IL6 signal peptide. The His tag protein sequence was added in order to allow an easier purification of the expressed proteins can. The resultant DNA sequences of HSSTROL3_P9 (SEQ ID NO:1783) (MMP11_354) and WT MMP11 (SEQ ID NO: 1782) (MMP11_488) including the tag sequence are shown in FIG.

Figure 88A:
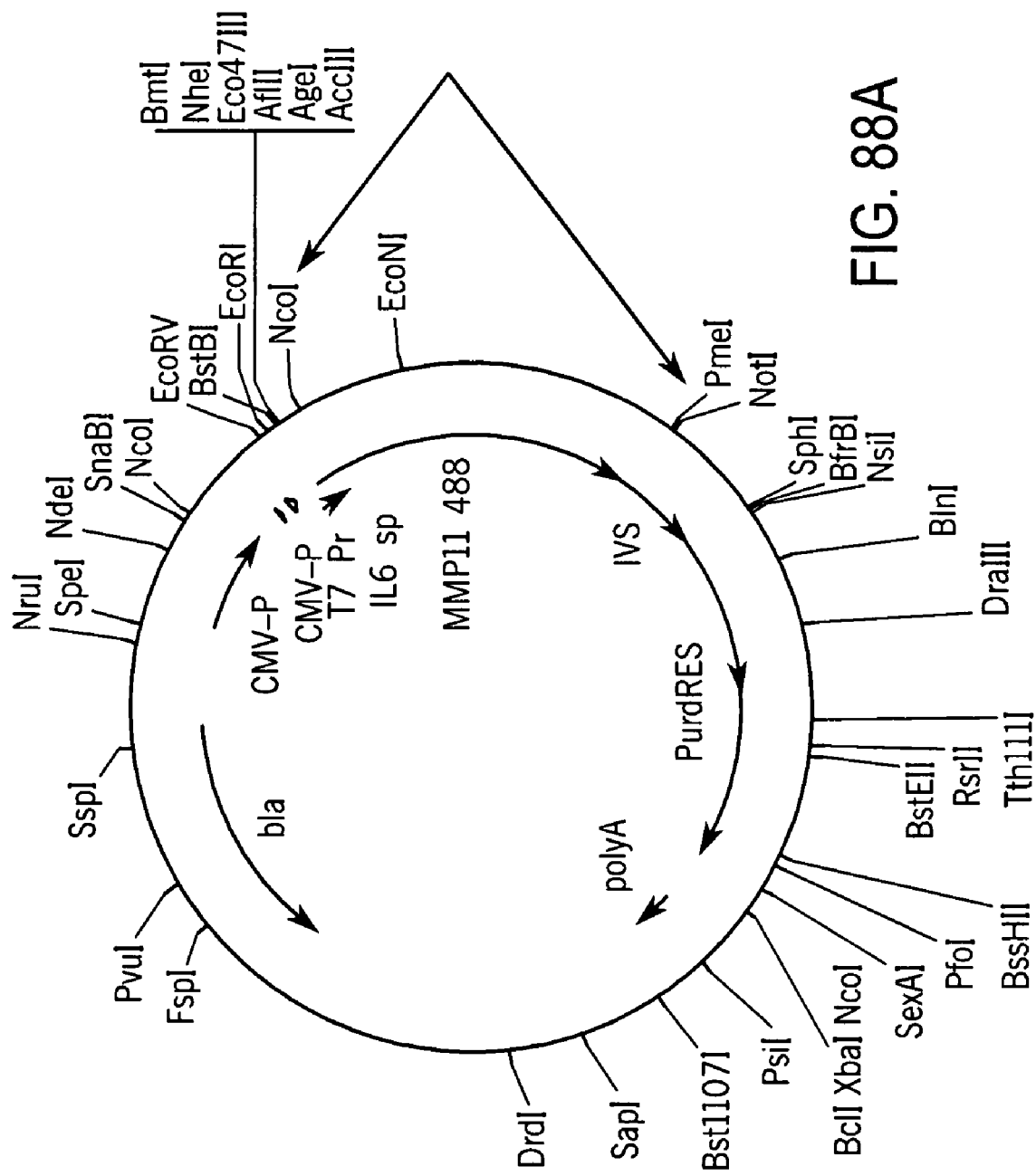
FIG. 88 shows WT MMP11 (MMP11488) and HSSTROL3_P9 (MMP11_354) in pIRESpuro3 plasmid maps. NcoI and NotI sites that were used to subclone MMP11 variants into bacterial expression vectors are marked by arrows.
Figure 88B:
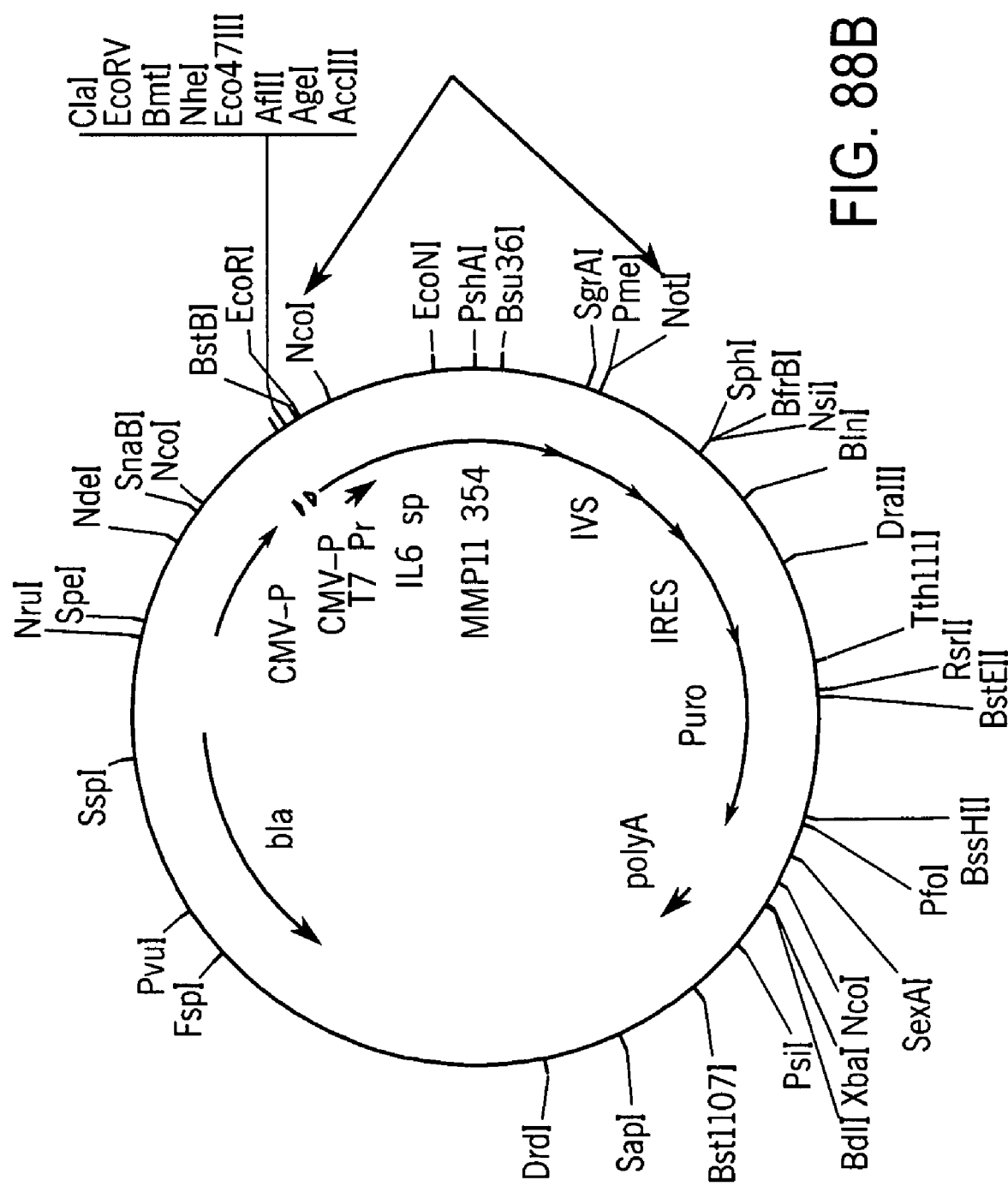

86; while the amino acid sequences are shown in FIG. 87 (SEQ ID NO:1785 and SEQ ID NO:1784, respectively). The DNA fragments were cloned into EcoRI/NotI sites of pIRESpuro3 (Clontech, cat #PT3646-5) (FIG. 88) and the sequences were verified.

1.1.2 Bacterial Cloning and Expression of MMP11 Proteins

WT MMP11 (MMP11_488) and HSSTROL3_P9 (MMP11_354) inserts, encoding WT MMP1 (MMP11_488) (SEQ ID NO:1786) and HSSTROL3_P9 (MMP11_354) (SEQ ID NO:1787), were isolated from MMP11_488 pIRESpuro3 and MMP11_354 pIRESpuro3, respectively by double digestion with NcoI and NotI. The sites are marked in the sequences in FIG. 86, and by arrows in FIG. 89.

Figure 89A:
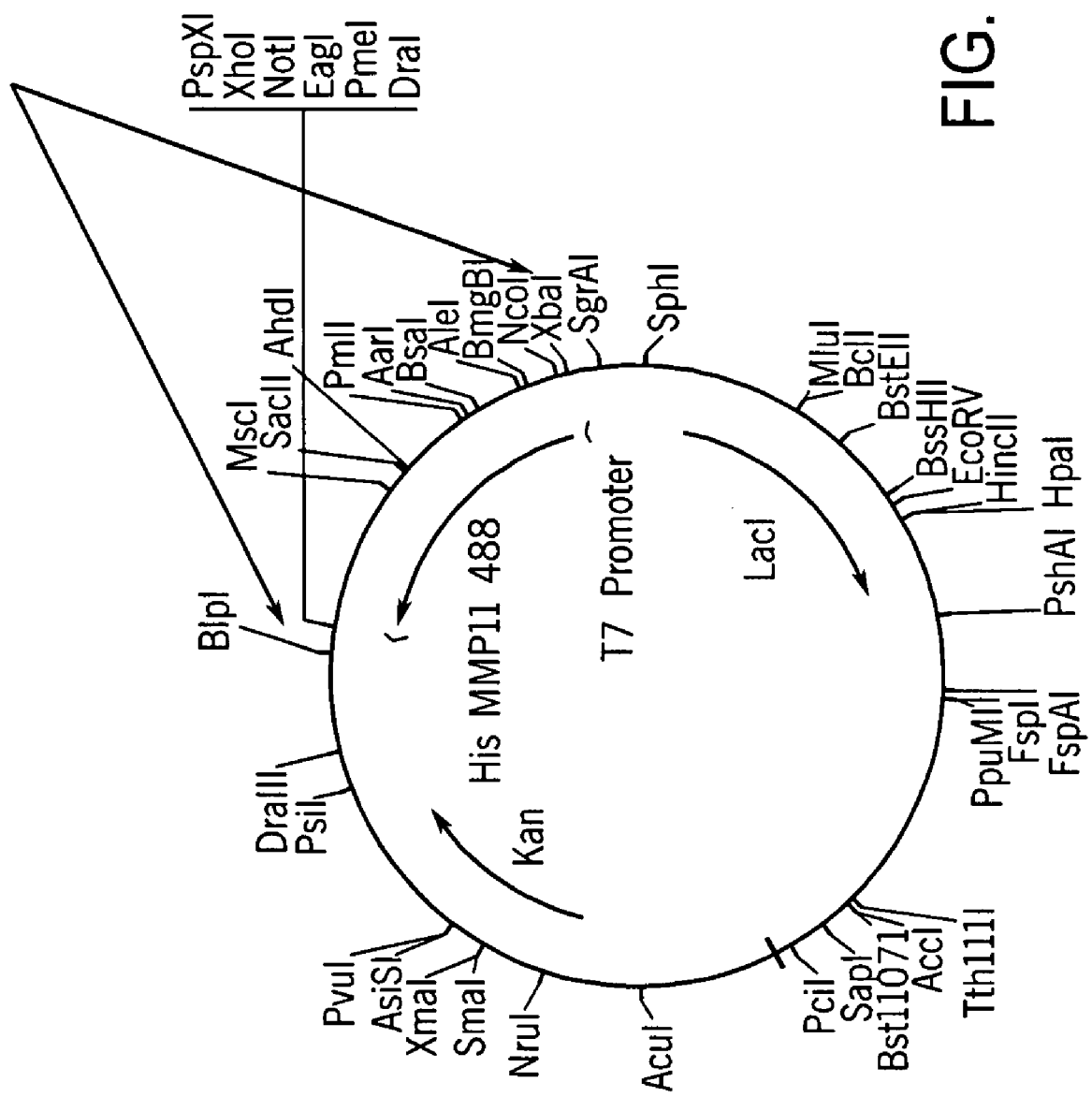
FIG. 89 shows WT MMP11 (MMP11_488) and HSSTROL3_P9 (MMP11_354) in pET28 plasmid maps. NcoI and NotI sites that were used to subclone MMP11 (WT and variant) into bacterial expression vectors are marked with arrows.
Figure 89B:
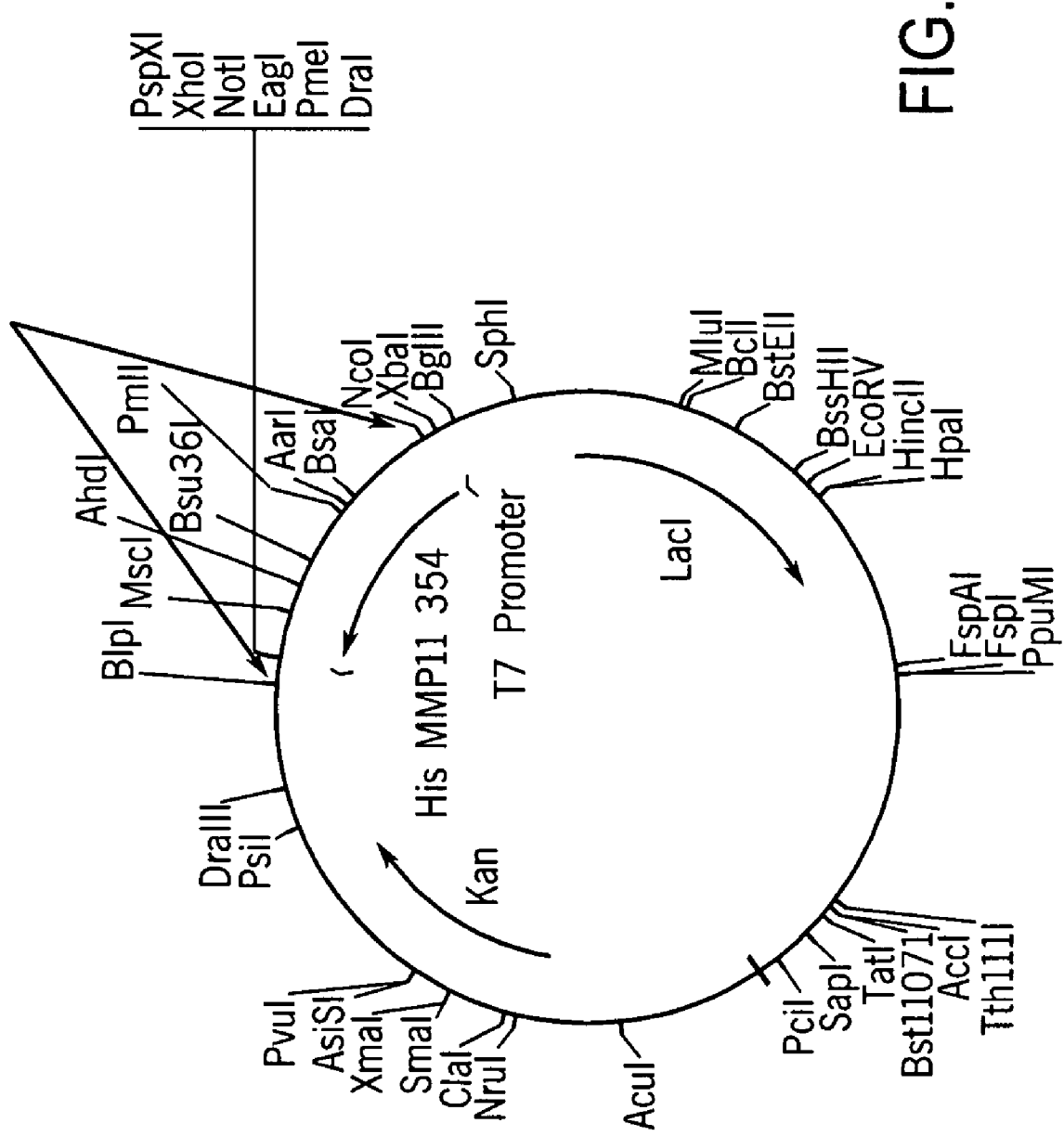

The inserts were ligated to pET28 previously digested with the same enzymes (plasmid maps and protein sequences are given in FIGS. 89 and 90 respectively). The ligation mix was transformed into DH5alpha competent cells. The transformation solutions were plated on selective LB plates containing Kanamycin. Several colonies from each transcript clone that grew on the selective plates were taken for further analysis by re-plating on a selective plate and by restriction enzyme analysis.

Figure 91:
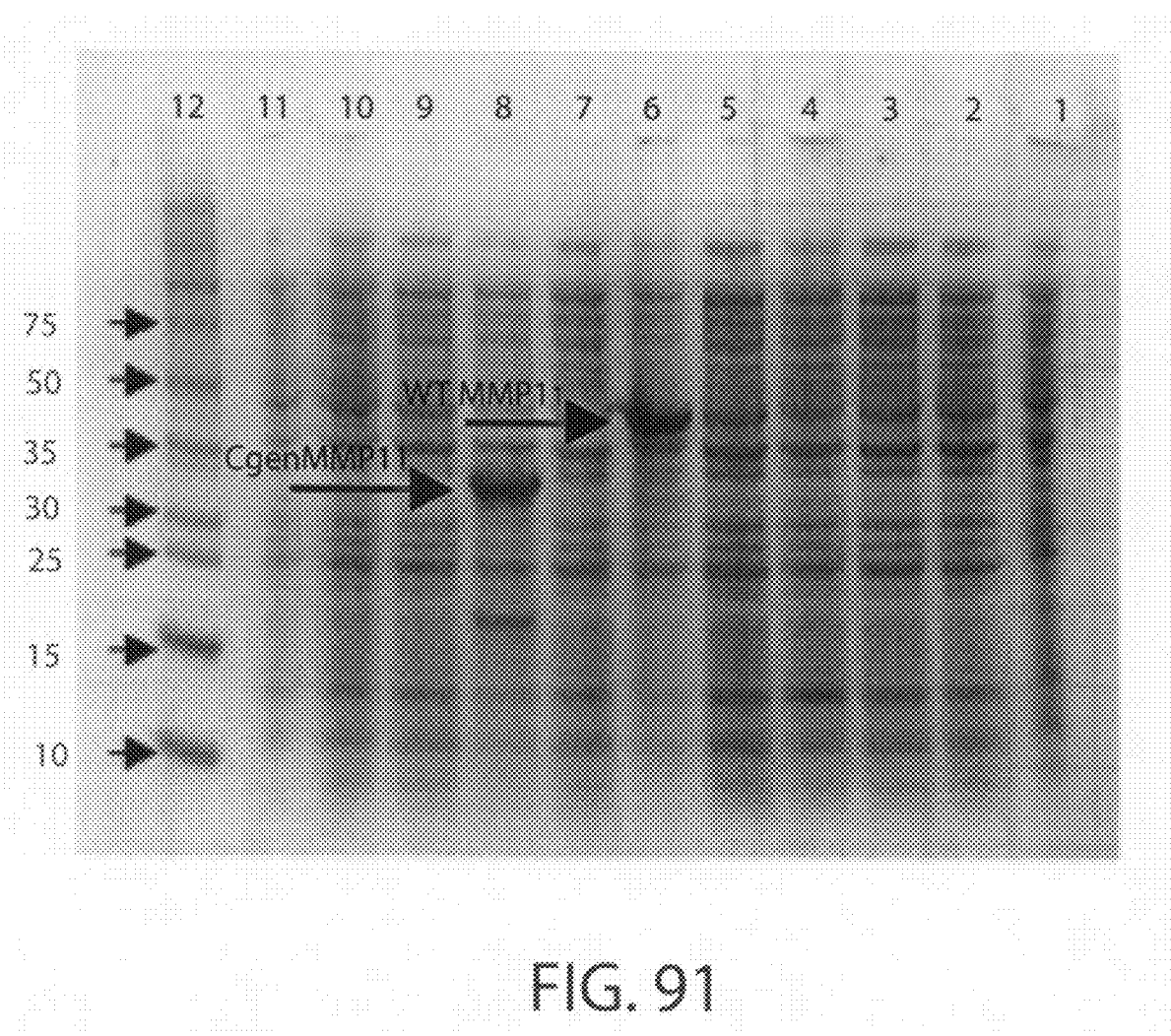
FIG. 91 shows a Coomassie staining of whole cell lysates MMP11_488 and MMP11_354 in pET28. Lanes 1 to 4 and Lane 11 are unrelated to this experiment; Lane 5 is MMP11_488 pET28, before induction; Lane 6 is MMP11_488 pET28, 3 hrs after induction; Lane 7 is MMP11_354 pET28, before induction; Lane 8 is MMP11_354 pET28, 3 hrs after induction; Lane 9 is Empty pET 28, before induction; Lane 10 is Empty pET 28, 3 hrs after induction; Lane 12 is Rainbow Full Range Molecular Weight Markers GE Healthcare, RPN800
Figure 92:
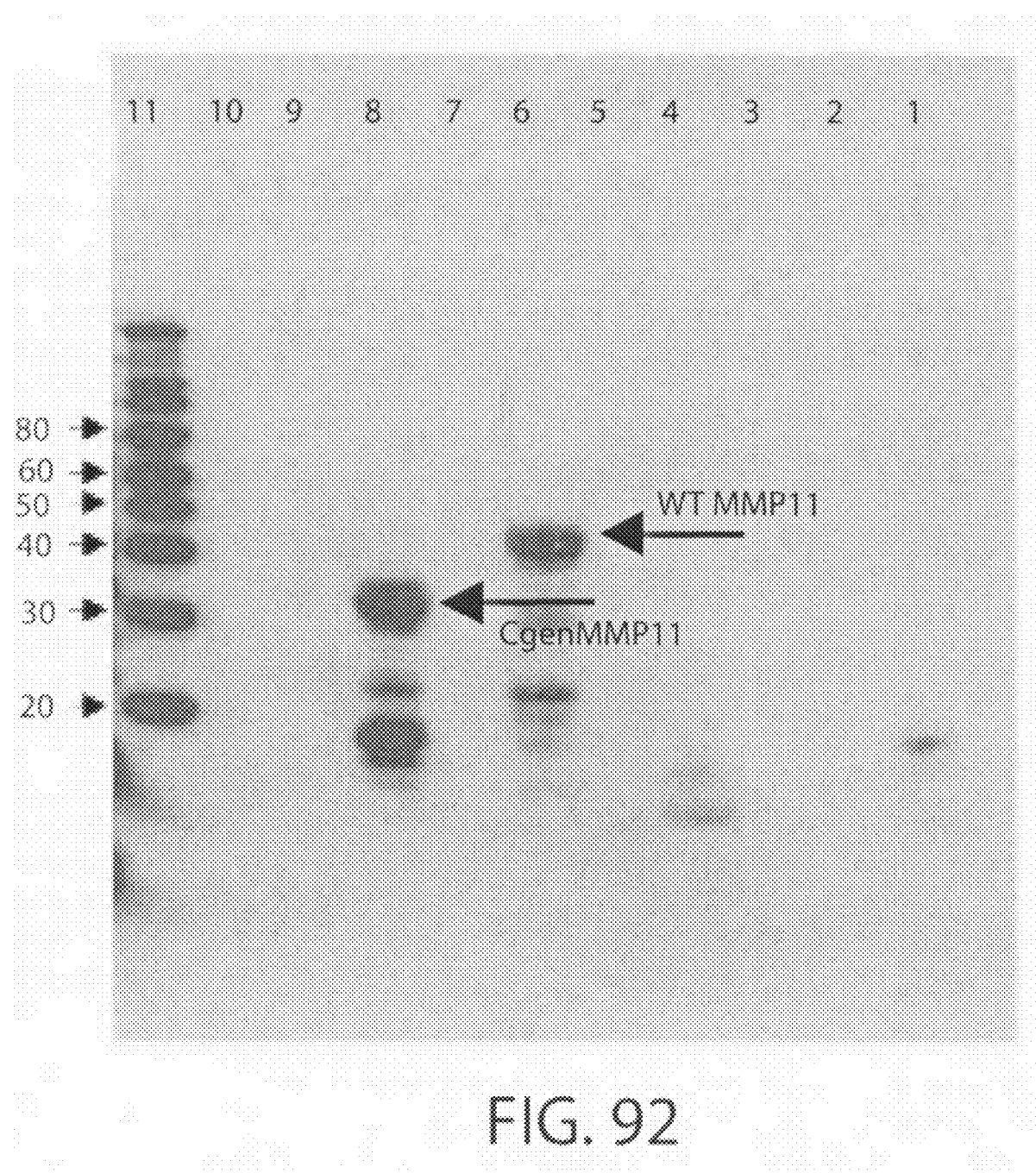
FIG. 92 shows a western blot analysis of whole cell lysates of MMP11_448 and MMP11_354 in pET28 with anti-His antibody (Serotec Cat. # MCA1396). Lane 5 is MMP11_488 pET28, before induction; Lane 6 is MMP11_488 pET28, 3 hrs after induction; Lane 7 is MMP11_354 pET28, before induction; Lane 8 is MMP11_354 pET28, 3 hrs after induction; Lane 9 is Empty pET 28, before induction; Lane 10 is Empty pET 28, 3 hrs after induction; Lane 11 is Mark Western Protein Standard: Invitrogen LC5600.

DNA from positive clones was extracted and transformed into BL21 codon plus (DE3) RIL competent cells (Stratagene Cat no. 230245). Small scale expression was performed following induction with 1 mM IPTG at 37° C. for 3 hrs. Expression of the recombinant proteins was detected in the whole cell lysates, both by Coomassie staining (FIG. 91) and by Western blot (FIG. 92) using anti-His antibodies (Serotec, Cat. # MCA1396).

1.2. Bacterial Production of HSSTROL3_P9 (SEQ ID NO:1787) and WT MMP11 (SEQ ID NO:1786).

Bacterial cultures expressing WT MMP11 (SEQ ID NO:1786) and HSSTROL3_P9 (SEQ ID NO:1787) (pET28, BL21+codon) were prepared as described above and 50 µl culture were used to start production. The cultures were propagated over-night in 50 ml LB medium supplemented with selection antibiotics (Kanamycin 10 ug/ml, Chloramphenicol 34 ug/ml), at 37° C., 200 rpm and then expanded to a final volume of 1 L each. After a few hours, when the cultures reached $OD_{600}$ of 0.5-0.7, induction was carried out with 1 mM IPTG. Following three hours after induction, upon cells reaching a density of 1.3-1.4 $OD_{600}$, cultures were centrifuged at 6000 g for 10 min and supernatant was discarded. Cell pellets were stored at −20° C. until purification.

1.3 Purification of MMP11_354 (HSSTROL3_P9 (SEQ ID NO:1787)) and MMP11_488 (WT MMP11) (SEQ ID NO:1786).

1.3.1. Purification of HSSTROL3_P9 (MMP11354) (SEQ ID NO:1787)

The bacterial cell pellet of 1 liter culture expressing HSSTROL3_P9 (MMP11_354, (SEQ ID NO:1787)) prepared as described above, was re-suspended in 50 ml of lysis buffer (50 mM Tris pH 7.5, 100 mM KCl, 0.5% triton ×100, 0.1 mg/ml lysozyme) and incubated for 1 hour at room temperature. The cells were further disrupted by sonication on ice (Misonix XL2020, microtip). The inclusion bodies were collected by centrifugation and washed 3 times with 30 ml wash buffer 1 (50nM tris pH 7.5, 2M NaCl 0.5% triton) and then twice with 30 ml wash buffer 2 (50 mM tris pH 7.5), by re-suspension and centrifugation as described above.

Washed inclusion bodies were resuspended in 1/20 original culture volume of 8M urea buffer (8M urea, 50 mM tris, 10 mM DTT, pH 8.5) and incubated for 2 hours at RT. The dissolved inclusion bodies were diluted ×10 in binding buffer (8M urea, 50 mM tris, 300 mM NaCl 20 mM imidazole) and incubated for 17 hours at 37° C. with Ni-NTA Superflow beads (Ni-NTA Superflow®, IBA) that were equilibrated with 5 column volumes (CV) of WFI followed by 10 CV of binding buffer with 1 mM DTT. The beads were packed in XK16 column and washed with binding buffer containing 1 mM DTT. The bound protein was eluted with elution buffer (8M urea, 50 mM Tris, 0.3M NaCl, 1 mM DTT, 0.25M imidazole, pH 8.0).

The eluted protein was diluted ×8.3 with binding buffer+1 mM DTT and refolded gradually by dialysis against buffer containing decreasing urea concentrations in 50 mM tris pH 8.5, 100mM NaCl, 10 mM $CaCl_2$ and 100 µM $ZnCl_2$. The final buffer pH was adjusted to 7.4.

After dialysis the refolded protein was filtered through 0.22 µm filter and concentrated ×5 on 10,000 MWCO membrane (Amicon, Cat# PBGC06210). The concentrated protein was centrifuged to eliminate aggregates.

A sample of the purified protein was analyzed by SDS-PAGE stained by Coomassie (not shown). The identity of the proteins was verified by LC-MS/MS.

1.3.2. Purification of WT MMP11 (MMP11488, (SEQ ID NO:1786))

The bacterial cell pellet of 1 liter culture expressing WT MMP11 (MMP11_488) (SEQ ID NO:1786) prepared, as described above, was re-suspended in 50 ml of lysis buffer (50 mM Tris pH 7.5, 100 mM KCl, 0.5% triton ×100, 0.1 mg/ml lysozyme) and incubated for 1 hour at room temperature. The cells were further disrupted by sonication on ice (Misonix XL2020, microtip). The inclusion bodies were collected by centrifugation and washed 3 times with 30 ml wash buffer 1 (50 mM tris pH 7.5, 2M NaCl 0.5% triton) and then twice with 30 ml wash buffer 2 (50nM tris pH 7.5), by re-suspension and centrifugation as described above.

Washed inclusion bodies were resuspended in 1/20 original culture volume of 8M urea buffer (8M urea, 50 mM tris, 10 mM DTT, pH 8.5) and incubated for 2 hours at RT. The dissolved inclusion bodies were diluted 10× in binding buffer (8M urea, 50 mM tris, 300 mM NaCl 20 mM imidazole) and incubated for 17 hours at 37° C. with Ni-NTA Superflow beads (Ni-NTA Superflow®, IBA) that were equilibrated with 5 column volumes (CV) of WFI followed by 10 CV of binding buffer with 1 mM DTT. The beads were packed in XK16 column and washed with binding buffer containing 1 mM DTT. The bound protein was eluted with elution buffer (8M urea, 50 nM Tris, 0.3M NaCl, 1 mM DTT, 0.25M imidazole, pH 8.0).

The eluted protein was treated with 10 mM DTT for 30 min at room temperature and then diluted gradually ×8 with dilution buffer (0.5M arginine, 50mM tris pH 8.5, 100 mM NaCl, 5 mM $CaCl_2$, 1 µM $ZnCl_2$, 5% glycerol, 0.5% Tween 20, 1 mM DTT pH 9). Following dialysis against the dilution buffer the protein was dialysed against the final buffer containing 50 mM Tris pH 7.4, 100 mM NaCl, 5 mM $CaCl_2$, 1 µM $ZnCl_2$, 1 mM DTT.

After dialysis the refolded protein was filtered through 0.22 um filter, concentrated ×3-5 on 10,000 MWCO membrane and the concentrated protein was centrifuged to eliminate aggregates. A sample of the purified protein was analyzed by SDS-PAGE stained by Coomassie (not shown). The identity of the proteins was verified by LC-MS/MS.

2 Antibody Development

In order to test HSSTROL3_P9 (SEQ ID NO:1398) protein expression pattern in serum samples of diseased and healthy individuals, both monoclonal and polyclonal antibodies were developed that had sufficient binding specificity to permit the specific analysis of this protein.

The antibody of interest had to recognize HSSTROL3_P9 (SEQ ID NO:1398) without recognizing WT MMP11 (SEQ ID NO:1455). Therefore, serum titers as well as resultant antibodies were tested against both protein preparations following a successful recognition of the immunogen.

2.1 Peptide Design and Synthesis

One peptide was selected as immunogen for monoclonal and polyclonal antibody development for the unique splice variant. The peptide sequence of HSSTROL3_P9 (SEQ ID NO:1398) unique tail was used as a template.

Selected immunogen: The primary sequence of the immunogen peptide (CGEN6301, SEQ ID NO:1781) is shown below. The terminal cysteine residue was used to facilitate coupling via m-maleimidobenzoyl-N-hydroxysuccinimide ester (MBS) to KLH. Ahx stand for a 6-aminohexanoic acid.

Peptide CGEN6301 (SEQ ID NO:1781): CKK-Ahx-FFQGT-TGVSTPAPGV

The peptide represents the C terminus of the protein; therefore the C-terminus of the immunogen was left unblocked. The peptide immunogen indicated above is overlaid on the primary sequence of the protein (SEQ ID NO: 1398) is shown in FIG. 93.

The immunogen peptide was synthesized using a conventional technology (50 mg; purity ≧90%). The peptide was conjugated to Keyhole Limpet Hemocyanin (KLH) and Bovine Serum Albumin (BSA) using an m-maleimidobenzoyl-N-hydroxysuccinimide ester (MBS) linker.

2.2 Rabbit Polyclonal Antibody Development 2.2.1. Rabbit Immunization and Sera Testing Three New Zealand White Rabbits (referred to herein by number as 8350, 8351 and 8352) were immunized with CGEN6301 conjugated with KLH. Immunization schedule and production bleed schedules are summarized in Tables 1066 and 1067, respectively.

TABLE 1066

Summary of rabbit immunization and test bleed schedule.

| | | Scheduled Date | | | | |
|---|---|---|---|---|---|---|
| Rabbit # | Pre Bleed | Initial Injection (500 µg ID/CFA) | Boost #1 (250 µg ID/IFA) | Boost #2 (250 µg SC/IFA) | Boost #3 (250 µg SC/IFA) | Test Bleed #1 |
| 8350 | Jun. 12, 2006 | Jun. 16, 2006 | Jun. 23, 2006 | Jun. 30, 2006 | Jul. 14, 2006 | Jul. 24, 2006 |
| 8351 | Jun. 12, 2006 | Jun. 16, 2006 | Jun. 23, 2006 | Jun. 30, 2006 | Jul. 14, 2006 | Jul. 24, 2006 |
| 8352 | Jun. 12, 2006 | Jun. 16, 2006 | Jun. 23, 2006 | Jun. 30, 2006 | Jul. 14, 2006 | * |

*Rabbit 8352 expired on Jul. 21, 2006

TABLE 1067

Summary of rabbit production bleed schedule.

| | | | | Scheduled Date | | | | | |
|---|---|---|---|---|---|---|---|---|---|
| Rabbit # | Production Bleed #1 | Production Bleed #2 | Production Bleed #3 | Production Bleed #4 | Production Bleed #5 | Production Bleed #6 | Production Bleed #7 | Production Bleed #8 | Terminal Bleed |
| 8350 | Aug. 3, 2006 | Aug. 14, 2006 | Aug. 21, 2006 | Sep. 4, 2006 | Sep. 11, 2006 | Sep. 18, 2006 | Sep. 25, 2006 | Oct. 2, 2006 | Nov. 6, 2006 |
| 8351 | Aug. 3, 2006 | Aug. 14, 2006 | Aug. 21, 2006 | Sep. 4, 2006 | Sep. 11, 2006 | Sep. 18, 2006 | Sep. 25, 2006 | Oct. 2, 2006 | Nov. 6, 2006 |

Production bleeds were collected and antibody titers were determined by ELISA using CGEN6301 peptide conjugated to BSA, recombinant HSSTROL3_P9 (SEQ ID NO:1787) splice variant and WT MMP11 (SEQ ID NO:1786) (not shown). Rabbit 8352 expired on Jul. 21, 2006 therefore; no test bleed and no production bleeds were collected from this rabbit.

2.2.2 Rabbit Polyclonal Antibody Affinity Purification

Affinity purification was performed on all production bleeds collected from the two rabbits (8350 and 8351) using a CGEN6301 immunoaffinity resin. Two passes of PBS diluted antiserum (1:1) were run on immunoaffinity resin prepared by coupling 10 mg of the CGEN6301 peptide to agarose beads. The purified product was concentrated to approximately 1 mg/ml and dialyzed against 1XPBS. The yield obtained from these purifications is summarized in Table 1068 below.

TABLE 1068

Affinity purified antibody yield

| Lot Number | Rabbit | Concentration | Volume | Total Yield | Buffer |
|---|---|---|---|---|---|
| 18976C | 8350 | 1.20 mg/ml | 45.0 ml | 54.2 mg | 0.02M Potassium Phosphate, 0.15M Sodium Chloride, pH 7.2, |
| 18977C | 8351 | 1.15 mg/ml | 75.0 ml | 86.3 mg | 0.02M Potassium Phosphate, 0.15M Sodium Chloride, pH 7.2, |

Figure 94:
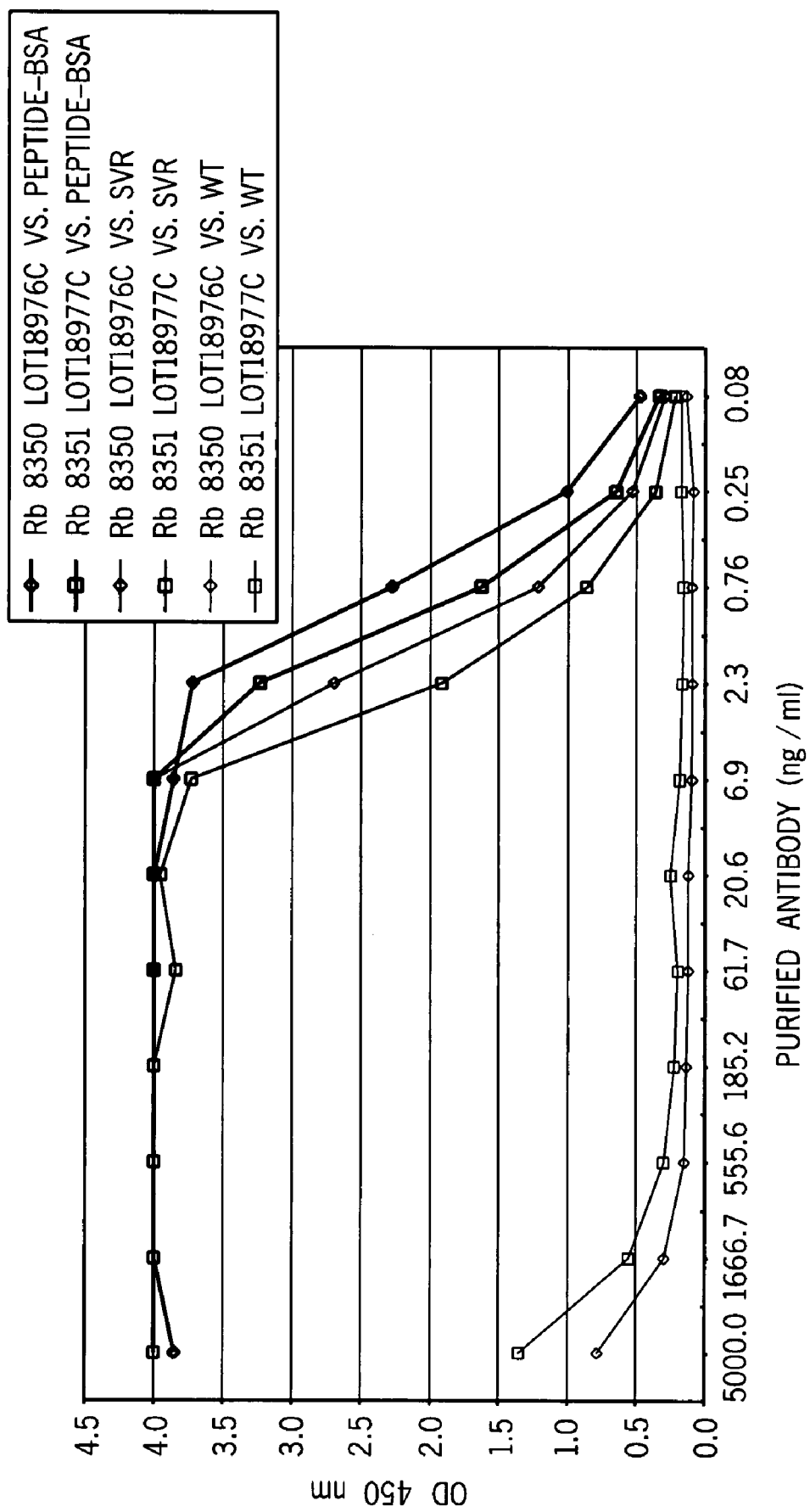
FIG. 94 shows CGEN6301 Affinity Purified Antibodies—ELISA results of Lot18976C (Rabbit 8350), and Lot18977C (Rabbit 8351).

Purified antibodies were assayed by ELISA for reactivity towards the immunogen conjugated to BSA, recombinant splice variant protein and wild type protein. Results are summarized in FIG. 94. These two antibody preparations showed a good recognition of HSSTROL3_P9 ((SEQ ID NO:1787) and low recognition of WT MMP11 (SEQ ID NO:1786). Therefore, both lots were used for Assay Development.

Figure 95:
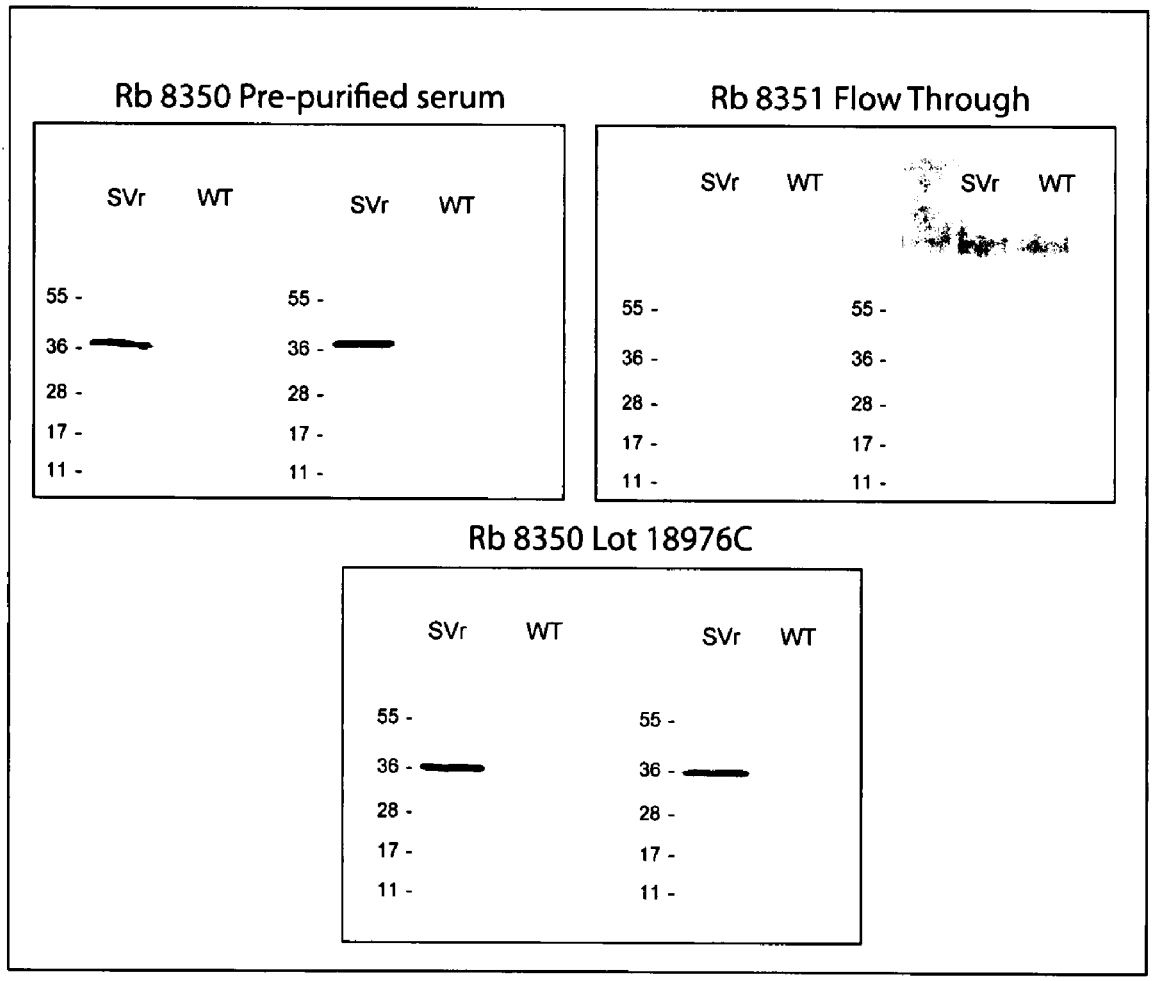
FIG. 95 shows Western Blot Data of Affinity Purified Antibody; Lot 18976C, Rabbit 8350. HSSTROL3_P9 splice variant protein (SVr) and WT MMP11 protein (WT) were probed (in duplicates) with pre-purified serum of RB 8350 (upper left), flow through from affinity purification, (upper right) and affinity purified antibody (lower) Lot 18976C.
Figure 96:
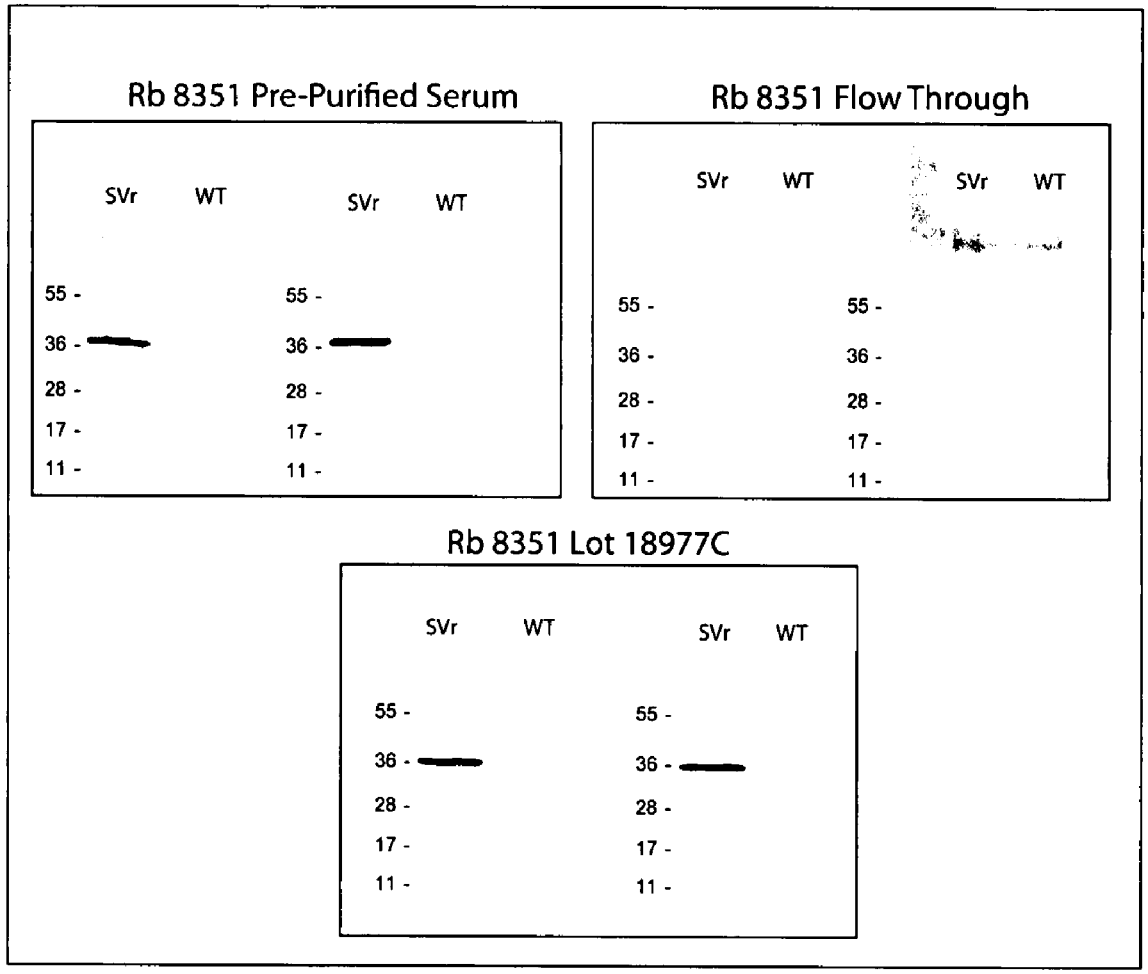
FIG. 96 shows Western Blot Data of Affinity Purified Antibody; Lot 18977C Rabbit 8351. HSSTROL3_P9 splice variant protein (SVr) and WT MMPL11 protein (WT) were probed with pre-purified serum, RB 8351 (upper left), flow through from affinity purification (upper right) and affinity purified antibody Lot 18977C (lower).

Reactivity of the purified antibodies to both the splice variant and the wild type proteins was also tested by a Western blot analysis. The results showed good recognition of HSSTROL3_P9 (SEQ ID NO:1787) splice variant and no recognition of the WT MMP11 (SEQ ID NO:1786) protein (see FIGS. 95 and 96).

2.3. Mouse Monoclonal Antibody Development
2.3.1 Mouse Immunization and Sera Testing Twenty Balb/c mice were immunized with CGEN6301 conjugated to KLH. Immunization and bleeding schedules are summarized in Table 1069.

1. Primary Screening Step
   a. Direct ELISA using Cgen6301 peptide-BSA conjugate: Only positive reacting clones with sufficiently high titers (OD at 450 nm >2) were carried forward.
   b. Class and subclass determination: Positive clones were expanded and isotyped to determine antibody class and subclass. Only IgG class antibodies were carried forward. The preferred order of subclass clones is: $IgG_1 > IgG_{2a} > IgG_{2b} > IgG_3$.

Clones that were approved by the primary screening criteria were transferred for secondary screening.

2. Secondary Screening Step: Direct ELISA using HSSTROL3_P9 (SEQ ID NO:1787) splice variant protein and WT MMP11 (SEQ ID NO:1786) protein. Only clones reacting positively with the splice variant and negatively with the wild type protein were carried forward.

TABLE 1069

Summary of Mouse Immunizations, Test Bleeds and Final Boosting Schedules.

| Peptide # | Pre-Bleed | Initial Injection (100 ug IP/CFA) | Boost #1 (50 ug IP/IFA) | Test Bleed #1 | Boost #2 (50 ug IP/IFA) | Test Bleed #2 | Boost #3 (50 ug IP/IFA) | Test Bleed #3 | Final Boost (50 ug IP) |
|---|---|---|---|---|---|---|---|---|---|
| CGEN6301 | Jun. 20, 2006 | Jun. 22, 2006 | Jul. 6, 2006 | Jul. 17, 2006 | Jul. 27, 2006 | Aug. 7, 2006 | Sep. 19, 2006 | Sep. 29, 2006 | Aug. 25, 2006 Aug. 26, 2006 Oct. 9, 2006 |

Test bleeds were collected and antibody titers were determined by ELISA using CGEN6301 peptide conjugated to BSA, HSSTROL3_P9 (SEQ ID NO:1787) splice variant and WT MMP11 protein (SEQ ID NO:1786) (data not shown).

Out of twenty mice immunized with CGEN6301 peptide, 6 showed high antibody titers to HSSTROL3_P9 (SEQ ID NO:1787) splice variant and limited recognition of the WT MMP11 protein (SEQ ID NO:1786). These were selected for hybridoma production.

2.3.2. Cell Fusion and Screening

Hybridoma cell lines were developed by performing splenocyte:myeloma fusions using the spleens from two mice for each fusion. Three fusions in total, were performed using the best mice responders. The fusion partner used was the SP2/0 Ag 14 (CRL-1581) myeloma cell line. The splenocytes and cell line were fused using polyethylene glycol. The fused cells were allowed to grow for 7-10 days prior to screening. The resulting hybridoma clones were screened by a two step strategy described below:

Data collected during the secondary screening of post-fusion products is summarized in Table 1070 below.

TABLE 1070

Summary of Secondary Screening Results for Post-Fusion Clones.

| Peptide Immunogen | Parental Clone Designation | Isotype(s) | Reactivity in Direct ELISA (OD 450 nm) Peptide-BSA | SVr | WT |
|---|---|---|---|---|---|
| CGEN6301 | 13E1 | IgG3 | 3.404 | >4.000 | 0.125 |
| | 5A10 | IgG3 | 3.073 | >4.000 | 0.106 |
| | 7B7 | IgG3 | 2.794 | >4.000 | 0.088 |
| | 5A8 | * | 1.900 | 3.837 | 0.084 |
| | 12F6 | * | 2.101 | 1.789 | 0.100 |
| | 5C6 | * | 2.337 | >4.000 | 0.130 |
| | 7G5 | * | 2.149 | 2.725 | 0.099 |
| | 7G11 | IgG1 | 2.274 | 2.602 | 0.115 |
| | 5F6 | IgG3 | 2.104 | 3.945 | 0.120 |

TABLE 1070-continued

Summary of Secondary Screening Results for Post-Fusion Clones.

| Peptide Immunogen | Parental Clone Designation | Isotype(s) | Reactivity in Direct ELISA (OD 450 nm) | | |
|---|---|---|---|---|---|
| | | | Peptide-BSA | SVr | WT |
| | 5D5 | IgG3 | 2.004 | >4.000 | 0.153 |
| | 5D6 | IgG3 | 2.763 | >4.000 | 0.143 |

*Mixed population - parental clones demonstrated more then one isotype, once determined monoclonal the clones were re-isotyped A total of 11 positive parental clones were identified for HSSTROL3_P9 (SEQ ID NO:1398) project.

These were then transferred for expansion and subcloning in order to prepare monoclonal cell populations.

2.3.3. Subcloning and Colony Expansion

Up to 2 subclones per positive parental clone were obtained by limiting dilution for each of the 11 clones transferred to this stage. All subclones generated in this step were evaluated by a direct ELISA test with CGEN6301 peptide-BSA conjugate, HSSTROL3_P9 (SEQ ID NO:1787) splice variant and WT MMP11 (SEQ ID NO:1786) proteins.

Table 1071 shows reactivity of successfully subcloned parental cell lines produced from splenocyte fusions of animals injected with CGEN6301. All subclones designated in table 1071 were cryopreserved for future long term use.

TABLE 1071

Summary of Secondary Screening Results for CGEN6301 Peptide Immunizations.

| Peptide Immunogen | Parental Clone Designation | Isotype(s) | Subclone Designation | Reactivity in Direct ELISA (OD 450 nm) | | |
|---|---|---|---|---|---|---|
| | | | | Peptide-BSA | SVr | WT |
| CGEN6301 | 5A10 | IgG3/kappa | 5A10.HI | 3.441 | >4.000 | 0.228 |
| | 5A10 | IgG3/kappa | 5A10.H6 | 3.321 | >4.000 | 0.211 |
| | 13E1 | IgG3/kappa | 13E1.G1.F3 | 3.316 | >4.000 | 0.143 |
| | 13E1 | IgG3/kappa | 13E1.G1.G1 | 3.236 | >4.000 | 0.159 |
| | 7B7 | IgG3/kappa | 7B7.C12.E12 | 2.920 | >4.000 | 0.114 |
| | 7B7 | IgG3/kappa | 7B7.C12.F7 | 2.968 | >4.000 | 0.108 |
| | 5D6 | IgG3/kappa | 5D6.E3 | 3.548 | 3.906 | 0.248 |
| | 5D6 | IgG3/kappa | 5D6.H4 | 3.502 | 3.929 | 0.290 |
| | 5D5 | IgG3/kappa | 5D5.G1 | 3.613 | >4.000 | 0.295 |
| | 5D5 | IgG3/kappa | 5D5.G7 | 3.502 | >4.000 | 0.290 |
| | 7G11 | IgG1/kappa | 7G11.F6.E1 | 3.418 | 3.740 | 0.231 |
| | 7G11 | IgG1/kappa | 7G11.F6.H4 | 3.211 | 3.746 | 0.208 |
| | 5F6 | IgG3/kappa | 5F6.E9.F4 | 3.528 | >4.000 | 0.299 |
| | 5F6 | IgG3/kappa | 5F6.E9.F5 | 3.408 | >4.000 | 0.322 |
| | 5C6 | IgG3/kappa | 5C6.H5.H8.H | 3.578 | >4.000 | 0.282 |
| | 5C6 | IgG3/kappa | 5C6.H5.H8.H | 3.475 | >4.000 | 0.297 |

2.3.4. Monoclonal Antibody Production and Purification

Subclones demonstrating high titers to HSSTROL3_P9 (SEQ ID NO:1787) and the immunogen peptide CGEN6301 low titers to WT MMP11 (SEQ ID NO:1786) were selected for antibody production (Table 1072).

TABLE 1072

Subclones Selected for Antibody Production.

| Peptide Immunogen | Parental Clone Designation | Isotype(s) | Subclone Designation |
|---|---|---|---|
| CGEN6301 | 13E1 | IgG3/kappa | 13E1.G1.F3 |
| | 7G11 | IgG1/kappa | 7G11.F6.E1 |

Subclones listed in Table 1072 were cultured in 2,000 ml roller bottles for antibody production. Protein A purification was performed on 200 ml of ×10 concentrated roller bottle supernatant diluted with an equal volume of sample buffer. A single pass was run over a Protein A sepharose column and the eluted product was dialyzed against PBS. Prior to final vialing each antibody was filter sterilized (0.22 um).

Antibody yield and concentration were determined after purification using conventional methods and are summarized in Table 1073.

TABLE 1073

Monoclonal Antibody Yield and Concentration.

| Peptide Immunogen | Subclone Designation | Protein Concentration (mg/ml) | Volume (ml) | Yield Amount (mg) | Lot# | Buffer |
|---|---|---|---|---|---|---|
| CGEN6301 | 13E1.G1.F3 | 2.26 mg/ml | 58 ml | 131 mg | 18944C | 0.02 M Potassium Phosphate, 0.15 M Sodium Chloride, pH |
| | 7G11.F6.E1 | 1.37 mg/ml | 68 ml | 93 mg | 19032C | 0.02 M Potassium Phosphate, 0.15 M Sodium Chloride, pH |

Figure 97:
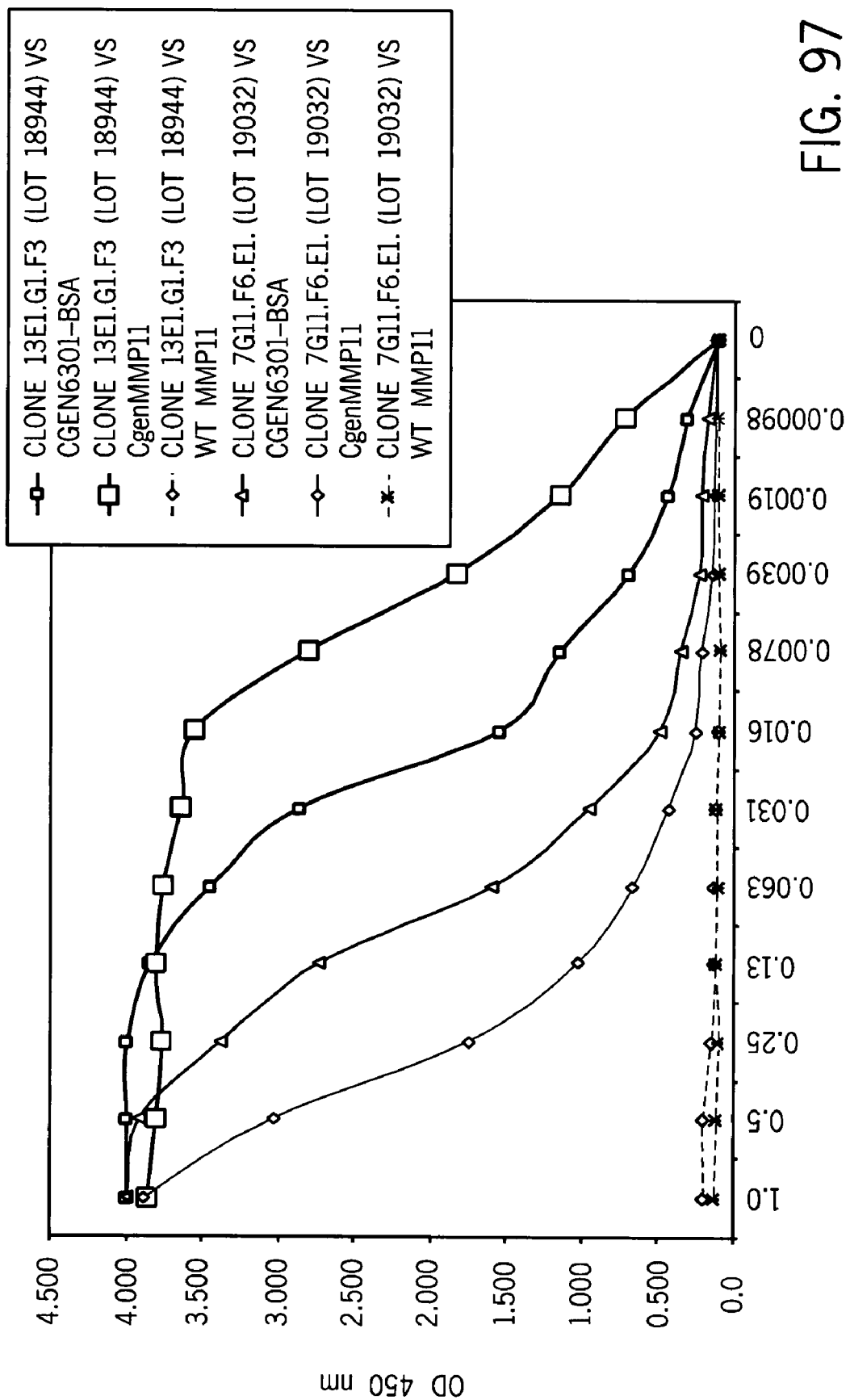
FIG. 97 shows CGEN6301 Monoclonal Purified Antibodies—ELISA results of Clone 13E1.G1.F3. (lot18944C) and Clone 7G11.F6.E1. (lot19032C).

Purified antibodies were assayed by ELISA for reactivity towards CGEN6301 peptide (SEQ ID NO:1781) conjugated to BSA, HSSTROL3_P9 (SEQ ID NO:1787) splice variant and WT MMP11 (SEQ ID NO:1786). Results appear in FIG. 97. FIG. 97 shows that clone 13E1.G6.F3 (lot 18944C) has a higher recognition towards HSSTROL3_P9 (SEQ ID NO:1787) splice variant and CGEN6301 (SEQ ID NO:1781) peptide than clone 7G01.F6.E1 (antibody lot 19032).

3. HSSTROL3_P9 (SEQ ID NO:1398) Assay Development

Next the Assay Development stage of HSSTROL3_P9 (SEQ ID NO:1398) project was performed with serum samples of Non Small Cell Lung Carcinoma patients and controls (ie patients who were not suffering from lung cancer).

Four antibodies, described above, were used for assay development
  Two polyclonal antibodies, (Rockland polyclonals Rabbit 8350 & Rabbit 8351) developed against a synthetic peptide CKK-Ahx-FFQGTTGVSTPAPGV (SEQ ID NO:1781) comprising the unique tail of the HSSTROL3_P9 (SEQ ID NO:1398).
  Two monoclonal antibodies (Rockland monoclonals clone 13E1.G1.F3 and clone 7G11.F6.E1) developed against a synthetic peptide CKK-Ahx-FFQGTTGVSTPAPGV (SEQ ID NO:1781) comprising the unique tail of HSSTROL3_P9 (SEQ ID NO:1398).

Three ELISA formats were developed in order to identify the most sensitive assay format for the detection of HSSTROL3_P9 (SEQ ID NO:1398) splice variant protein in serum:
  Sandwich ELISA
  Antibody capture competitive ELISA
  Antigen capture competitive ELISA 3.1. Sandwich ELISA In order to find the best sandwich pair, various combinations of antibodies raised in different hosts were tested for their ability to detect serial dilutions of HSSTROL3_P9 (SEQ ID NO:1787) spiked in serum. Antibodies from the same host were not tested in this format.

The best sandwich assay format for the detection of HSSTROL3_P9 (SEQ ID NO:1398) was found to be:
  Format #1:

| | |
|---|---|
| Coat: | Mab 13E1.G1.F3 |
| Detector | Rabbit polyclonal (Rb 8351) |
| LOD for HSSTROL3_P9 (SEQ ID NO:1787) | ~30 ng/ml |

3.2 Competitive ELISA

Two competitive assay formats were developed: antibody capture and antigen capture, and the best conditions were determined to each format.

3.2.1 Antigen Capture Competitive ELISA

ELISA plates were coated with HSSTROL3_P9 (SEQ ID NO:1787) protein and binding to antibody pre-incubated with HSSTROL3_P9 (SEQ ID NO:1787) protein-spiked serum samples was assessed.

The best optimized antigen capture assay was: Format #2:

| | |
|---|---|
| Coat | HSSTROL3_P9 (SEQ ID NO:1787) |
| Detector | Rabbit polyclonal (Rabbit 8351) |
| LOD for HSSTROL3_P9 (SEQ ID NO:1787) | ~70 ng/ml |

3.2.2. Antibody Capture Competitive ELISA

ELISA plates were coated with the antibody and its binding to labeled (biotinylated) HSSTROL3_P9 (SEQ ID NO:1787) protein-spiked serum samples was assessed. Non-labeled HSSTROL3_P9 (SEQ ID NO:1787) protein was tested as competing antigen; mouse 13E1.G1.F3 and both rabbit antibodies were tested as capture antibodies. The best optimized antibody capture assay format was: Format #3:

| | |
|---|---|
| Coat | Rabbit polyclonal (Rb 8351) |
| Detector | HSSTROL3_P9 |
| LOD for HSSTROL3_P9 (SEQ ID NO: 1787) | (SEQ ID NO:1787) biotin-labeled protein ~50 ng/ml |

The sandwich ELISA (Format #1) appeared to be somewhat more sensitive than both competitive formats (Formats #2&3). Therefore, this format was selected for screening the serum samples.

4. Serum Screening

Serum screening of 50 serum samples from Non Small Cell Lung Cancer (NSCLC) patients and 50 control sera were tested by using the above described HSSTROL3_P9 (SEQ ID NO:1398) sandwich assay.

4.1 Serum Samples Screening by Sandwich ELISA (Format #1)

The plates were coated overnight with mouse 13E1.G1.F1 antibody. Bound antigen was detected using rabbit 8351 antibodies. 50 sera from NSCLC patients, and 50 age and gender matched control sera (ie from subjects not suffering from lung cancer) were tested in this ELISA format. The 50 control serum samples consisted of 36 different samples plus duplicates of 14 of them. The reference curve was prepared by diluting HSSTROL3_P9 (SEQ ID NO:1787) splice variant protein into pooled normal serum.

The results showed that out of 100 samples tested in this assay only one sample (patient 1388P) was detected.

In order to verify the results observed in the first serum screening, a second serum screen was performed using the same sandwich ELISA format. The same 50 NSCLC patients and 28 out of the 50 control sera samples were assayed. The results observed were very similar to those obtained in the first serum test: the same one sample (1388P) was detected. The results of the two serum screens were therefore consistent.

The overall results suggest that HSSTROL3_P9 (SEQ ID NO:1398) is probably present in serum samples from lung cancer patients, however its concentration is too low to be detected by this assay format.

SUMMARY

A collection of monoclonal and polyclonal antibodies specific for HSSTROL3_P9 (SEQ ID NO:1398) splice variant was developed. These antibodies were used to test the potential of HSSTROL3_P9 (SEQ ID NO:1398) to become a diagnostic biomarker for Non Small Cell Lung Cancer diagnosis. A few ELISA formats were developed using this antibody collection for the determination of serum levels of HSSTROL3_P9 (SEQ ID NO:1398) splice variant in healthy and diseased individuals. The sandwich ELISA format was selected to test HSSTROL3_P9 (SEQ ID NO:1398) serum levels.

It appears that this ELISA format is not sufficiently sensitive to detect expression of HSSTROL3_P9 (SEQ ID NO:1398) in most of the tested samples. However HSSTROL3_P9 (SEQ ID NO:1398) splice variant was found consistently to be present in one serum sample, suggesting that it might be present also in other serum samples but below the detection limit.

It is likely that improving assay sensitivity by 10 fold through the use of antibodies with higher binding affinities or by the use of novel detection technologies will allow the detection of CenMMP11 in serum samples. A more sensitive test may reliably enable the assessment of HSSTROL3_P9 (SEQ ID NO:1398) diagnostic potential.

Conclusions

HSSTROL3_P9 (SEQ ID NO:1398) splice variant appears to be a specific molecular diagnostic marker for lung cancer.

Description for Cluster HUMTREFAC

Cluster HUMTREFAC features 2 transcript(s) and 7 segment(s) of interest, the names for which are given in Tables 1074 and 1075, respectively, the sequences themselves are given at the end of the application. The selected protein variants are given in table 1076.

TABLE 1074

Transcripts of interest

| Transcript Name | Sequence ID No. |
| --- | --- |
| HUMTREFAC_PEA_2_T4 | 131 |
| HUMTREFAC_PEA_2_T5 | 132 |

TABLE 1075

Segments of interest

| Segment Name | Sequence ID No. |
| --- | --- |
| HUMTREFAC_PEA_2_node_0 | 903 |
| HUMTREFAC_PEA_2_node_9 | 904 |
| HUMTREFAC_PEA_2_node_2 | 905 |
| HUMTREFAC_PEA_2_node_3 | 906 |
| HUMTREFAC_PEA_2_node_4 | 907 |
| HUMTREFAC_PEA_2_node_5 | 908 |
| HUMTREFAC_PEA_2_node_8 | 909 |

TABLE 1076

Proteins of interest

| Protein Name | Sequence ID No. | Corresponding Transcript(s) |
| --- | --- | --- |
| HUMTREFAC_PEA_2_P7 | 1399 | HUMTREFAC_PEA_2_T5 (SEQ ID NO:132) |
| HUMTREFAC_PEA_2_P8 | 1400 | HUMTREFAC_PEA_2_T4 (SEQ ID NO:131) |

These sequences are variants of the known protein Trefoil factor 3 precursor (SwissProt accession identifier TFF3_HUMAN; known also according to the synonyms Intestinal trefoil factor; hP1.B), SEQ ID NO:1456, referred to herein as the previously known protein.

Protein Trefoil factor 3 precursor (SEQ ID NO:1456) is known or believed to have the following function(s): May have a role in promoting cell migration (motogen). The sequence for protein Trefoil factor 3 precursor is given at the end of the application, as "Trefoil factor 3 precursor amino acid sequence". Known polymorphisms for this sequence are as shown in Table 1077.

TABLE 1077

Amino acid mutations for Known Protein

| SNP position(s) on amino acid sequence | Comment |
| --- | --- |
| 74-76 | QEA -> TRKT |

Protein Trefoil factor 3 precursor (SEQ ID NO:1456) localization is believed to be Secreted.

The following GO Annotation(s) apply to the previously known protein. The following annotation(s) were found: defense response; digestion, which are annotation(s) related to Biological Process; and extracellular, which are annotation(s) related to Cellular Component.

The GO assignment relies on information from one or more of the SwissProt/TremnBI Protein knowledgebase, available from <dot expasy dot ch/sprot/>; or Locuslink, available from <dot ncbi dot nlm dot nih dot gov/projects/LocusLink/>.

Cluster HUMTREFAC can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 41 refer to weighted expression of ESTs in each category, as "parts per million" (ratio of the expression of ESTs for a particular cluster to the expression of all ESTs in that category, according to parts per million).

Figure 41:
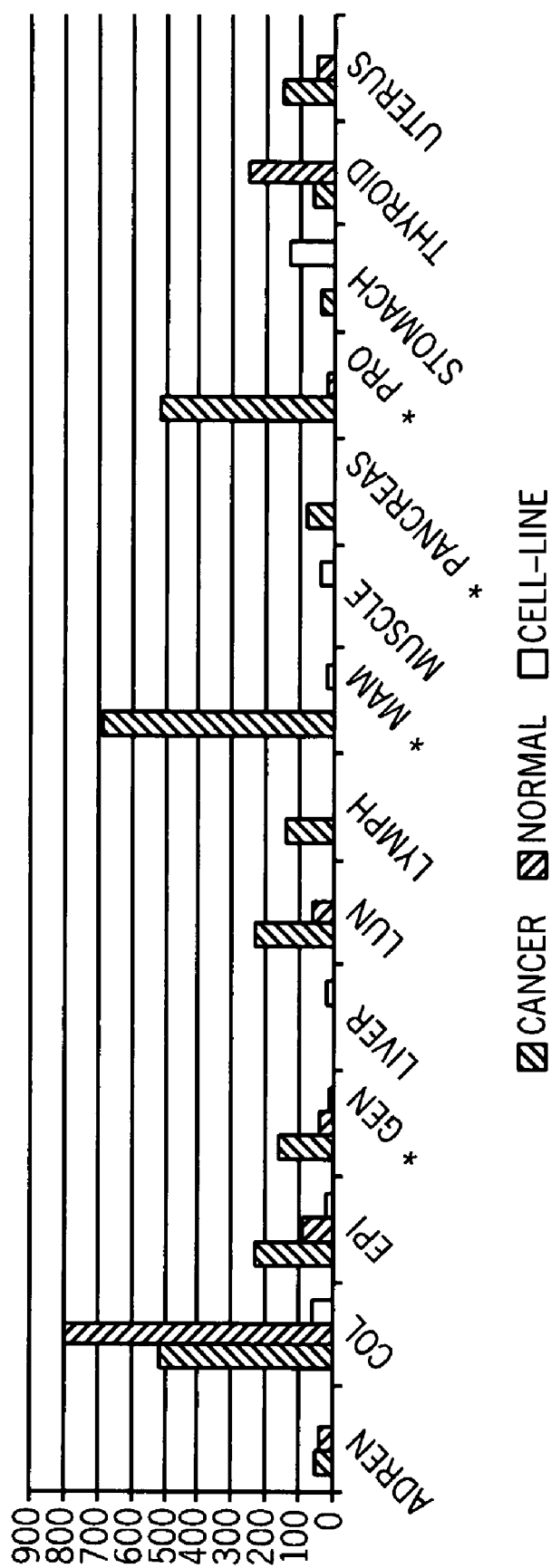
FIG. 41 is a histogram showing Cancer and cell-line vs. normal tissue expression for Cluster HUMTREFAC, demonstrating overexpression in a mixture of malignant tumors from different tissues, breast malignant tumors, pancreas carcinoma and prostate cancer.

Overall, the following results were obtained as shown with regard to the histograms in FIG. 41 and Table 1078. This cluster is overexpressed (at least at a minimum level) in the following pathological conditions: a mixture of malignant tumors from different tissues, breast malignant tumors, pancreas carcinoma and prostate cancer.

TABLE 1078

Normal tissue distribution

| Name of Tissue | Number |
|---|---|
| adrenal | 40 |
| colon | 797 |
| epithelial | 95 |
| general | 39 |
| liver | 0 |
| lung | 57 |
| lymph nodes | 3 |
| breast | 0 |
| muscle | 3 |
| pancreas | 2 |
| prostate | 16 |
| stomach | 0 |
| Thyroid | 257 |
| uterus | 54 |

TABLE 1079

P values and ratios for expression in cancerous tissue

| Name of Tissue | P1 | P2 | SP1 | R3 | SP2 | R4 |
|---|---|---|---|---|---|---|
| adrenal | 6.4e−01 | 6.9e−01 | 7.1e−01 | 1.1 | 7.8e−01 | 0.9 |
| colon | 4.6e−01 | 5.7e−01 | 9.7e−01 | 0.5 | 1 | 0.4 |
| epithelial | 2.4e−02 | 3.4e−01 | 9.5e−10 | 2.0 | 5.3e−02 | 1.1 |
| general | 2.5e−04 | 3.9e−02 | 1.4e−28 | 3.6 | 1.9e−10 | 1.9 |
| liver | 1 | 6.8e−01 | 1 | 1.0 | 6.9e−01 | 1.4 |
| lung | 4.8e−01 | 7.6e−01 | 2.2e−03 | 1.0 | 1.6e−01 | 0.5 |
| lymph nodes | 5.1e−01 | 8.0e−01 | 2.3e−02 | 5.0 | 1.9e−01 | 2.1 |
| breast | 7.6e−02 | 1.2e−01 | 3.1e−06 | 12.0 | 1.1e−03 | 6.5 |
| muscle | 9.2e−01 | 4.8e−01 | 1 | 0.8 | 3.9e−01 | 2.1 |
| pancreas | 1.2e−01 | 2.4e−01 | 5.7e−03 | 6.5 | 2.1e−02 | 4.6 |
| prostate | 1.5e−01 | 2.7e−01 | 9.9e−10 | 8.1 | 3.1e−07 | 5.7 |
| stomach | 3.0e−01 | 1.3e−01 | 5.0e−01 | 2.0 | 6.7e−02 | 2.8 |
| Thyroid | 6.4e−01 | 6.4e−01 | 9.6e−01 | 0.5 | 9.6e−01 | 0.5 |
| uterus | 4.1e−01 | 7.3e−01 | 7.5e−02 | 1.3 | 4.0e−01 | 0.8 |

As noted above, cluster HUMTREFAC features 2 transcript(s), which were listed in Table 1074 above. These transcript(s) encode for protein(s) which are variant(s) of protein Trefoil factor 3 precursor (SEQ ID NO:1456). A description of each variant protein according to the present invention is now provided.

Variant protein HUMTREFAC_PEA_2_P7 (SEQ ID NO:1399) according to the present invention has an amino acid sequence as given at the end of the application; it is encoded by transcript(s) HUMTREFAC_PEA_2_T5 (SEQ ID NO:132). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P7 (SEQ ID NO:1399) also has the following non-silent SNPs (Single Nucleotide Polymorphisms) as listed in Table 1080, (given according to their position(s) on the amino acid sequence, with the alternative amino acid(s) listed; the last column indicates whether the SNP is known or not; the presence of known SNPs in variant protein HUMTREFAC_PEA_2_P7 (SEQ ID NO:1399) sequence provides support for the deduced sequence of this variant protein according to the present invention).

TABLE 1080

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |
| 43 | L -> M | No |
| 60 | P -> S | Yes |
| 123 | S -> * | Yes |

Variant protein HUMTREFAC_PEA_2_P7 (SEQ ID NO:1399) is encoded by the following transcript(s): HUMTREFAC_PEA_2_T5 (SEQ ID NO:132), for which the sequence(s) is/are given at the end of the application. The coding portion of transcript HUMTREFAC_PEA_2_T5 (SEQ ID NO:132) is shown in bold; this coding portion starts at position 278 and ends at position 688. The transcript also has the following SNPs as listed in Table 1081 (given according to their position on the nucleotide sequence, with the alternative nucleic acid listed; the last column indicates whether the SNP is known or not; the presence of known SNPs in variant protein HUMTREFAC_PEA_2_P7 (SEQ ID NO:1399) sequence provides support for the deduced sequence of this variant protein according to the present invention).

TABLE 1081

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |
| 404 | C -> A | No |
| 404 | C -> T | No |
| 455 | C -> T | Yes |
| 645 | C -> A | Yes |
| 685 | C -> T | No |

Variant protein HUMTREFAC_PEA_2_P8 (SEQ ID NO:1400) according to the present invention has an amino acid sequence as given at the end of the application; it is encoded by transcript(s) HUMTREFAC_PEA_2_T4 (SEQ ID NO:131). An alignment is given to the known protein (Trefoil factor 3 precursor (SEQ ID NO:1456)) at the end of the application. One or more alignments to one or more previously published protein sequences are given at the end of the application. A brief description of the relationship of the variant protein according to the present invention to each such aligned protein is as follows:

Comparison report between HUMTREFAC_PEA_2_P8 (SEQ ID NO:1400) and TFF3_HUMAN (SEQ ID NO:1456):

1. An isolated chimeric polypeptide encoding for HUMTREFAC_PEA_2_P8 (SEQ ID NO:1400), comprising a first amino acid sequence being at least 90% homologous to MAARALCMLGLVLALLSSSSAEEYVGL corresponding to amino acids 1-27 of TFF3_HUMAN (SEQ ID NO:1456), which also corresponds to amino acids 1-27 of HUMTREFAC_PEA_2_P8 (SEQ ID NO:1400), and a second amino acid sequence being at least 70%, optionally at least 80%, preferably at least 85%, more preferably at least 90% and most preferably at least 95% homologous to a polypeptide having the sequence WKVHLPKGEGFSSG (SEQ ID NO:1774) corresponding to amino acids 28-41 of HUMTREFAC_ PEA_2_P8 (SEQ ID NO:1400), wherein said first amino acid sequence and second amino acid sequence are contiguous and in a sequential order.

2. An isolated polypeptide encoding for a tail of HUMTREFAC_PEA_2_P8 (SEQ ID NO:1400), comprising a polypeptide being at least 70%, optionally at least about 80%, preferably at least about 85%, more preferably at least about 90% and most preferably at least about 95% homologous to the sequence WKVHLPKGEGFSSG (SEQ ID NO:1774) in HUMTREFAC_PEA_2_P8 (SEQ ID NO:1400).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P8 (SEQ ID NO:1400) also has the following non-silent SNPs (Single Nucleotide Polymorphisms) as listed in Table 1082, (given according to their position(s) on the amino acid sequence, with the alternative amino acid(s) listed; the last column indicates whether the SNP is known or not; the presence of known SNPs in variant protein HUMTREFAC_PEA_2_P8 (SEQ ID NO:1400) sequence provides support for the deduced sequence of this variant protein according to the present invention).

TABLE 1082

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |

Variant protein HUMTREFAC_PEA_2_P8 (SEQ ID NO:1400) is encoded by the following transcript(s): HUMTREFAC_PEA_2_T4 (SEQ ID NO:131), for which the sequence(s) is/are given at the end of the application. The coding portion of transcript HUMTREFAC_PEA_2_T4 (SEQ ID NO:131) is shown in bold; this coding portion starts at position 278 and ends at position 400. The transcript also has the following SNPs as listed in Table 1083 (given according to their position on the nucleotide sequence, with the alternative nucleic acid listed; the last column indicates whether the SNP is known or not; the presence of known SNPs in variant protein HUMTREFAC_PEA_2_P8 (SEQ ID NO:1400) sequence provides support for the deduced sequence of this variant protein according to the present invention).

TABLE 1083

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |
| 515 | C -> A | No |
| 515 | C -> T | No |
| 566 | C -> T | Yes |
| 756 | C -> A | Yes |
| 796 | C -> T | No |
| 1265 | A -> C | No |
| 1266 | A -> T | No |

As noted above, cluster HUMTREFAC features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTREFAC_PEA_2_node_0 (SEQ ID NO:903) according to the present invention is supported by 188 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1084 below describes the starting and ending position of this segment on each transcript.

TABLE 1084

Segment location on transcripts

| Transcript name | Segment starting position | Segment ending position |
|---|---|---|
| HUMTREFAC_PEA_2_T4 (SEQ ID NO:131) | 1 | 359 |
| HUMTREFAC_PEA_2_T5 (SEQ ID NO:132) | 1 | 359 |

Segment cluster HUMTREFAC_PEA_2_node_9 (SEQ ID NO:904) according to the present invention is supported by 150 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1085 below describes the starting and ending position of this segment on each transcript.

TABLE 1085

Segment location on transcripts

| Transcript name | Segment starting position | Segment ending position |
|---|---|---|
| HUMTREFAC_PEA_2_T4 (SEQ ID NO:131) | 681 | 1266 |
| HUMTREFAC_PEA_2_T5 (SEQ ID NO:132) | 570 | 747 |

According to an optional embodiment of the present invention, short segments related to the above cluster are also provided. These segments are up to about 120 bp in length, and so are included in a separate description.

Segment cluster HUMTREFAC_PEA_2_node_2 (SEQ ID NO:905) according to the present invention is supported by 4 libraries. The number of libraries was determined as previously described. This segment can be found in the following transcript(s): HUMTREFAC_PEA_2_T4 (SEQ ID NO:131). Table 1086 below describes the starting and ending position of this segment on each transcript.

TABLE 1086

Segment location on transcripts

| Transcript name | Segment starting position | Segment ending position |
|---|---|---|
| HUMTREFAC_PEA_2_T4 (SEQ ID NO:131) | 360 | 470 |

Segment cluster HUMTREFAC_PEA_2_node_3 (SEQ ID NO:906) according to the present invention is supported by 10 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1087 below describes the starting and ending position of this segment on each transcript.

TABLE 1087

Segment location on transcripts

| Transcript name | Segment starting position | Segment ending position |
|---|---|---|
| HUMTREFAC_PEA_2_T4 (SEQ ID NO:131) | 471 | 514 |
| HUMTREFAC_PEA_2_T5 (SEQ ID NO:132) | 360 | 403 |

Segment cluster HUMTREFAC_PEA_2_node_4 (SEQ ID NO:907) according to the present invention is supported by 197 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1088 below describes the starting and ending position of this segment on each transcript.

TABLE 1088

Segment location on transcripts

| Transcript name | Segment starting position | Segment ending position |
|---|---|---|
| HUMTREFAC_PEA_2_T4 (SEQ ID NO:131) | 515 | 611 |
| HUMTREFAC_PEA_2_T5 (SEQ ID NO:132) | 404 | 500 |

Segment cluster HUMTREFAC_PEA_2_node_5 (SEQ ID NO:908) according to the present invention is supported by 187 libraries. The number of libraries was determined as previously described. This segment can be found in the following transcript(s): HUMTREFAC_PEA_2_T4 (SEQ ID NO:131) and HUMTREFAC_PEA_2_T5 (SEQ ID NO:132). Table 1089 below describes the starting and ending position of this segment on each transcript.

TABLE 1089

Segment location on transcripts

| Transcript name | Segment starting position | Segment ending position |
|---|---|---|
| HUMTREFAC_PEA_2_T4 (SEQ ID NO:131) | 612 | 661 |
| HUMTREFAC_PEA_2_T5 (SEQ ID NO:132) | 501 | 550 |

Segment cluster HUMTREFAC_PEA_2_node_8 (SEQ ID NO:909) according to the present invention can be found in the following transcript(s): HUMTREFAC_PEA_2_T4 (SEQ ID NO:131) and HUMTREFAC_PEA_2_T5 (SEQ ID NO:132). Table 1090 below describes the starting and ending position of this segment on each transcript.

TABLE 1090

Segment location on transcripts

| Transcript name | Segment starting position | Segment ending position |
|---|---|---|
| HUMTREFAC_PEA_2_T4 (SEQ ID NO:131) | 662 | 680 |
| HUMTREFAC_PEA_2_T5 (SEQ ID NO:132) | 551 | 569 |

Variant protein alignment to the previously known protein:

Sequence name: TFF3_HUMAN (SEQ ID NO:1456)

Sequence documentation:

Alignment of: HUMTREFAC_PEA_2_P8 (SEQ ID NO:1400) x TFF3_HUMAN (SEQ ID NO:1456) . . .

Alignment segment 1/1:

| Quality: | 246.00 | Escore: | 0 |
|---|---|---|---|
| Matching length: | 27 | Total length: | 27 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1   MAARALCMLGLVLALLSSSSAEEYVGL     27
    |||||||||||||||||||||||||||
1   MAARALCMLGLVLALLSSSSAEEYVGL     27
```

Description for Cluster HSS100PCB

Cluster HSS100PCB features 1 transcript(s) and 3 segment(s) of interest, the names for which are given in Tables 1091 and 1092, respectively, the sequences themselves are given at the end of the application. The selected protein variants are given in table 1093.

TABLE 1091

Transcripts of interest

| Transcript Name | Sequence ID No. |
|---|---|
| HSS100PCB_T1 | 133 |

TABLE 1092

Segments of interest

| Segment Name | Sequence ID No. |
|---|---|
| HSS100PCB_node_3 | 910 |
| HSS100PCB_node_4 | 911 |
| HSS100PCB_node_5 | 912 |

TABLE 1093

Proteins of interest

| Protein Name | Sequence ID No. | Corresponding Transcript(s) |
|---|---|---|
| HSS100PCB_P3 | 1401 | HSS100PCB_T1 (SEQ ID NO:133) |

These sequences are variants of the known protein S-100P protein (SwissProt accession identifier S10P_HUMAN), SEQ ID NO:1457, referred to herein as the previously known protein, which binds two calcium ions.

The sequence for protein S-100P protein (SEQ ID NO:1457) is given at the end of the application, as "S-100P protein amino acid sequence". Known polymorphisms for this sequence are as shown in Table 1094.

TABLE 1094

Amino acid mutations for Known Protein

| SNP position(s) on amino acid sequence | Comment |
|---|---|
| 32 | E -> T |
| 44 | F -> E |

The following GO Annotation(s) apply to the previously known protein. The following annotation(s) were found: calcium binding; protein binding, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HSS100PCB can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 42 refer to weighted expression of ESTs in each category, as "parts per million" (ratio of the expression of ESTs for a particular cluster to the expression of all ESTs in that category, according to parts per million).

Figure 42:
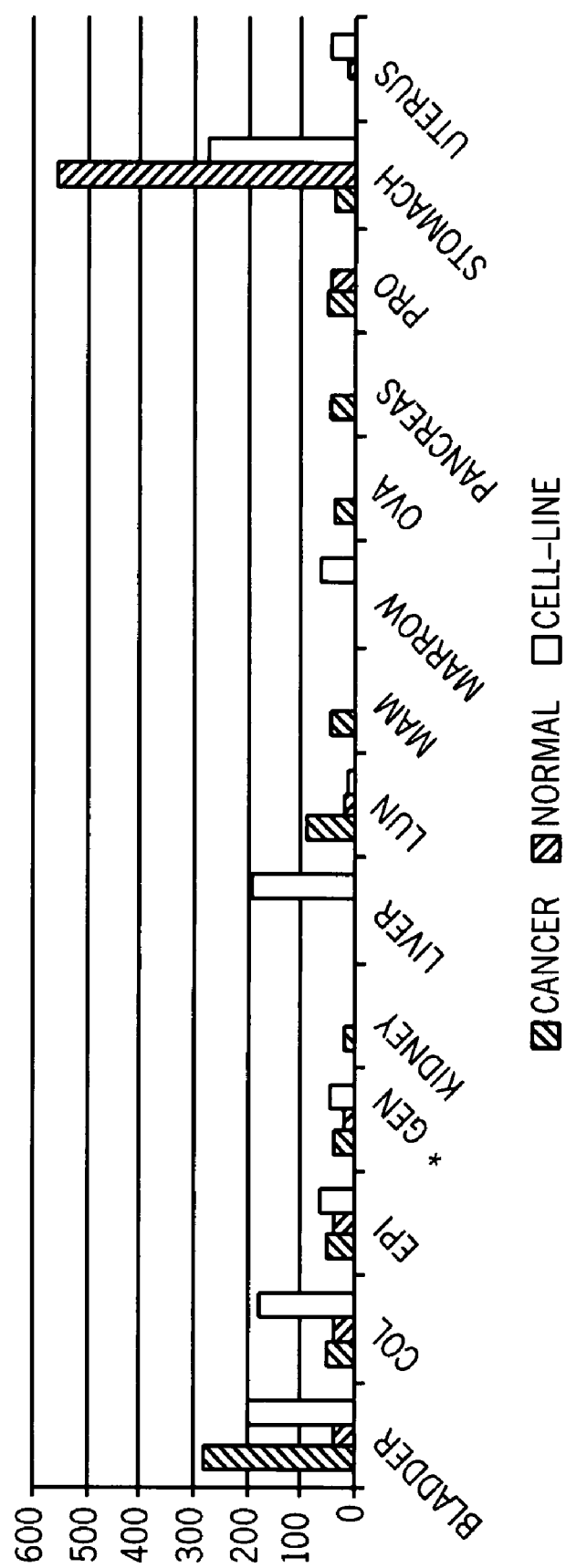
FIG. 42 is a histogram showing Cancer and cell-line vs. normal tissue expression for Cluster HSS100PCB, demonstrating overexpression in a mixture of malignant tumors from different tissues.

Overall, the following results were obtained as shown with regard to the histograms in FIG. 42 and Table 1095. This cluster is overexpressed (at least at a minimum level) in the following pathological conditions: a mixture of malignant tumors from different tissues.

TABLE 1095

Normal tissue distribution

| Name of Tissue | Number |
|---|---|
| bladder | 41 |
| colon | 37 |
| epithelial | 38 |
| general | 22 |
| kidney | 0 |
| liver | 0 |
| lung | 18 |
| breast | 0 |
| bone marrow | 0 |
| ovary | 0 |
| pancreas | 0 |
| prostate | 46 |
| stomach | 553 |
| uterus | 13 |

TABLE 1096

P values and ratios for expression in cancerous tissue

| Name of Tissue | P1 | P2 | SP1 | R3 | SP2 | R4 |
|---|---|---|---|---|---|---|
| bladder | 3.3e-01 | 2.9e-01 | 2.9e-02 | 2.8 | 3.5e-02 | 2.8 |
| colon | 3.0e-01 | 1.9e-01 | 5.2e-01 | 1.2 | 2.4e-01 | 1.7 |
| epithelial | 4.7e-02 | 1.6e-02 | 2.0e-01 | 1.2 | 6.1e-02 | 1.3 |
| general | 1.1e-03 | 6.8e-05 | 1.4e-02 | 1.5 | 4.9e-04 | 1 7 |
| kidney | 6.5e-01 | 7.2e-01 | 5.8e-01 | 1.7 | 7.0e-01 | 1.4 |
| liver | 9.1e-01 | 4.9e-01 | 1 | 1.0 | 7.7e-02 | 2.1 |
| lung | 6.8e-01 | 7.3e-01 | 2.2e-02 | 2.9 | 1.3e-01 | 1.7 |
| breast | 2.8e-01 | 3.2e-01 | 4.7e-01 | 2.0 | 6.8e-01 | 1.5 |
| bone marrow | 1 | 6.7e-01 | 1 | 1.0 | 2.8e-01 | 2.8 |
| ovary | 2.6e-01 | 3.0e-01 | 4.7e-01 | 2.0 | 5.9e-01 | 1.7 |
| pancreas | 3.3e-01 | 4.4e-01 | 7.6e-02 | 3.7 | 1.5e-01 | 2.8 |
| prostate | 9.1e-01 | 9.3e-01 | 5.8e-01 | 0.6 | 7.6e-01 | 0.5 |
| stomach | 3.7e-01 | 3.2e-01 | 1 | 0.1 | 1 | 0.3 |
| uterus | 9.4e-01 | 7.0e-01 | 1 | 0.6 | 4.1e-01 | 1.1 |

As noted above, cluster HSS100PCB features 1 transcript(s), which were listed in Table 1091 above. These transcript(s) encode for protein(s) which are variant(s) of protein S-100P protein (SEQ ID NO:1457). A description of each variant protein according to the present invention is now provided.

Variant protein HSS100PCB_P3 (SEQ ID NO:1401) according to the present invention has an amino acid sequence as given at the end of the application; it is encoded by transcript(s) HSS100PCB_T1 (SEQ ID NO:133). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSS100PCB_P3 (SEQ ID NO:1401) also has the following non-silent SNPs (Single Nucleotide Polymorphisms) as listed in Table 1097, (given according to their position(s) on the amino acid sequence, with the alternative amino acid(s) listed; the last column indicates whether the SNP is known or not; the presence of known SNPs in variant protein HSS100PCB_P3 (SEQ ID NO:1401) sequence provides support for the deduced sequence of this variant protein according to the present invention).

TABLE 1097

Amino acid mutations

| SNP position(s) on amino acid sequence | Alternative amino acid(s) | Previously known SNP? |
|---|---|---|
| 1 | M -> R | Yes |
| 11 | M -> L | Yes |
| 20 | L -> F | Yes |

Variant protein HSS100PCB_P3 (SEQ ID NO:1401) is encoded by the following transcript(s): HSS100PCB_T1 (SEQ ID NO:133), for which the sequence(s) is/are given at the end of the application. The coding portion of transcript HSS100PCB_T1 (SEQ ID NO:133) is shown in bold; this coding portion starts at position 1057 and ends at position 1533. The transcript also has the following SNPs as listed in Table 1098 (given according to their position on the nucleotide sequence, with the alternative nucleic acid listed; the last column indicates whether the SNP is known or not; the presence of known SNPs in variant protein HSS100PCB_P3 (SEQ ID NO:1401) sequence provides support for the deduced sequence of this variant protein according to the present invention).

TABLE 1098

Nucleic acid SNPs

| SNP position on nucleotide sequence | Alternative nucleic acid | Previously known SNP? |
|---|---|---|
| 52 | C -> T | Yes |
| 107 | A -> C | Yes |
| 458 | C -> T | Yes |
| 468 | A -> G | Yes |
| 648 | C -> T | Yes |
| 846 | C -> G | Yes |
| 882 | G -> A | Yes |
| 960 | C -> T | No |
| 965 | C -> T | Yes |
| 1058 | T -> G | Yes |
| 1087 | A -> C | Yes |
| 1114 | C -> T | Yes |
| 1968 | G -> A | Yes |
| 1971 | C -> T | Yes |
| 2010 | C -> A | Yes |
| 2099 | G -> | No |

As noted above, cluster HSS100PCB features 3 segment(s), which were listed in Table 1092 above and for which the sequence(s) are given at the end of the application. These segment(s) are portions of nucleic acid sequence(s) which are described herein separately because they are of particular interest. A description of each segment according to the present invention is now provided.

Segment cluster HSS100PCB_node_3 (SEQ ID NO:910) according to the present invention is supported by 16 libraries. The number of libraries was determined as previously described. This segment can be found in the following transcript(s): HSS100PCB_T1 (SEQ ID NO:133). Table 1099 below describes the starting and ending position of this segment on each transcript.

TABLE 1099

Segment location on transcripts

| Transcript name | Segment starting position | Segment ending position |
|---|---|---|
| HSS100PCB_T1 (SEQ ID NO:133) | 1 | 1133 |

Segment cluster HSS100PCB_node_4 (SEQ ID NO:911) according to the present invention is supported by 29 libraries. The number of libraries was determined as previously described. This segment can be found in the following transcript(s): HSS100PCB_T1 (SEQ ID NO:133). Table 1100 below describes the starting and ending position of this segment on each transcript.

TABLE 1100

Segment location on transcripts

| Transcript name | Segment starting position | Segment ending position |
|---|---|---|
| HSS100PCB_T1 (SEQ ID NO:133) | 1134 | 1923 |

Segment cluster HSS100PCB_node_5 (SEQ ID NO:912) according to the present invention is supported by 141 libraries. The number of libraries was determined as previously described. This segment can be found in the following transcript(s): HSS100PCB_T1 (SEQ ID NO:133). Table 1101 below describes the starting and ending position of this segment on each transcript.

TABLE 1101

Segment location on transcripts

| Transcript name | Segment starting position | Segment ending position |
|---|---|---|
| HSS100PCB_T1 (SEQ ID NO:133) | 1924 | 2201 |

Description for Cluster HSU33147

Cluster HSU33147 features 2 transcript(s) and 5 segment(s) of interest, the names for which are given in Tables 1102 and 1103, respectively, the sequences themselves are given at the end of the application. The selected protein variants are given in table 1104.

TABLE 1102

Transcripts of interest

| Transcript Name | Sequence ID No. |
|---|---|
| HSU33147_PEA_1_T1 | 1464 |
| HSU33147_PEA_1_T2 | 1465 |

TABLE 1103

Segments of interest

| Segment Name | Sequence ID No. |
|---|---|
| HSU33147_PEA_1_node_0 | 1276 |
| HSU33147_PEA_1_node_2 | 1277 |

TABLE 1103-continued

Segments of interest

| Segment Name | Sequence ID No. |
|---|---|
| HSU33147_PEA_1_node_4 | 1278 |
| HSU33147_PEA_1_node_7 | 1279 |
| HSU33147_PEA_1_node_3 | 1280 |

TABLE 1104

Proteins of interest

| Protein Name | Sequence ID No. | Corresponding Transcript(s) |
|---|---|---|
| HSU33147_PEA_1_P5 | 1415 | HSU33147_PEA_1_T1 (SEQ ID NO:1464); HSU33147_PEA_1_T2 (SEQ ID NO: 1465) |

These sequences are variants of the known protein Mammaglobin A precursor (SwissProt accession identifier MGBA_HUMAN; known also according to the synonyms Mammaglobin 1; Secretoglobin family 2A member 2), SEQ ID NO:1416, referred to herein as the previously known protein.

The sequence for protein Mammaglobin A precursor (SEQ ID NO:1416) is given at the end of the application, as "Mammaglobin A precursor amino acid sequence".

It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Immunostimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer.

The following GO Annotation(s) apply to the previously known protein. The following annotation(s) were found: steroid binding, which are annotation(s) related to Molecular Function.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HSU33147 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 43 refer to weighted expression of ESTs in each category, as "parts per million" (ratio of the expression of ESTs for a particular cluster to the expression of all ESTs in that category, according to parts per million).

Figure 43:
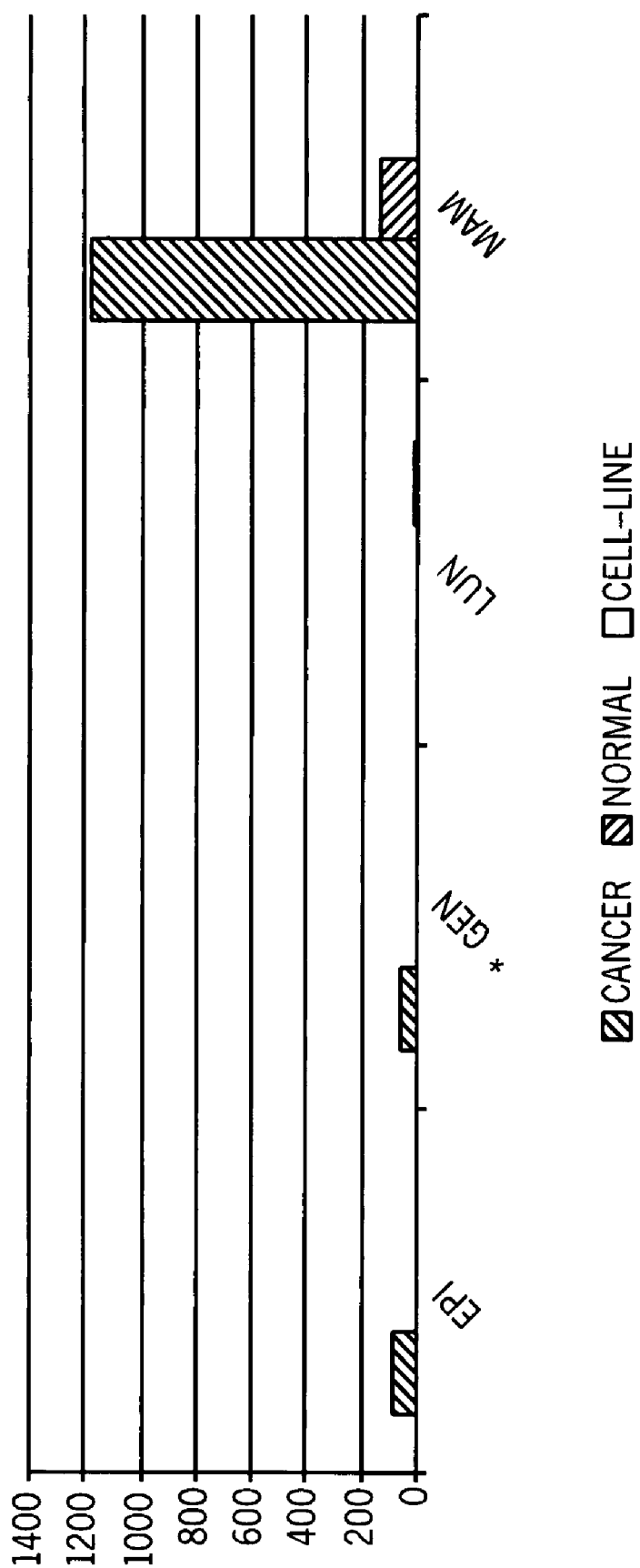
FIG. 43 is a histogram showing Cancer and cell-line vs. normal tissue expression for Cluster HSU33147, demonstrating overexpression in a mixture of malignant tumors from different tissues.

Overall, the following results were obtained as shown with regard to the histograms in FIG. 43 and Table 1105. This cluster is overexpressed (at least at a minimum level) in the following pathological conditions: a mixture of malignant tumors from different tissues.

TABLE 1105

Normal tissue distribution

| Name of Tissue | Number |
|---|---|
| epithelial | 6 |
| general | 2 |
| lung | 0 |
| breast | 131 |

TABLE 1106

P values and ratios for expression in cancerous tissue

| Name of Tissue | P1 | P2 | SP1 | R3 | SP2 | R4 |
|---|---|---|---|---|---|---|
| epithelial | 4.1e−02 | 6.4e−02 | 1.5e−12 | 2.6 | 2.2e−06 | 1.5 |
| general | 1.6e−02 | 1.1e−02 | 1.2e−22 | 4.4 | 7.2e−13 | 2.4 |
| lung | 1 | 6.3e−01 | 1 | 1.0 | 6.2e−01 | 1.6 |
| breast | 8.6e−02 | 1.1e−01 | 3.4e−07 | 1.7 | 2.6e−03 | 1.0 |

As noted above, cluster HSU33147 features 2 transcript(s), which were listed in Table 1102 above. These transcript(s) encode for protein(s) which are variant(s) of protein Mammaglobin A precursor (SEQ ID NO:1416). A description of each variant protein according to the present invention is now provided.

Variant protein HSU33147_PEA_1_P5 (SEQ ID NO:1415) according to the present invention has an amino acid sequence as given at the end of the application; it is encoded by transcript(s) HSU33147_PEA_1_T1 (SEQ ID NO:1464). An alignment is given to the known protein (Mammaglobin A precursor (SEQ ID NO:1416)) at the end of the application. One or more alignments to one or more previously published protein sequences are given at the end of the application. A brief description of the relationship of the variant protein according to the present invention to each such aligned protein is as follows:

Comparison report between HSU33147_PEA_1_P5 (SEQ ID NO:1415) and MGBA_HUMAN (SEQ ID NO:1416):

1. An isolated chimeric polypeptide encoding for HSU33147_PEA_1_P5 (SEQ ID NO:1415), comprising a first amino acid sequence being at least 90% homologous to MKLLMVLMLAALSQHCYAGSGCPLLENVISKTIN-PQVSKTEYKELLQEFIDDNATTNAIDELKECFLNQTD ETLSNVE corresponding to amino acids 1-78 of MGBA_HUMAN (SEQ ID NO:1416), which also corresponds to amino acids 1-78 of HSU33147_PEA_1_P5 (SEQ ID NO:1415), and a second amino acid sequence being at least 90% homologous to QLIYDSSLCDLF corresponding to amino acids 82-93 of MGBA_HUMAN (SEQ ID NO:1416), which also corresponds to amino acids 79-90 of HSU33147_PEA_1_P5 (SEQ ID NO:1415), wherein said first amino acid sequence and second amino acid sequence are contiguous and in a sequential order.

2. An isolated chimeric polypeptide encoding for an edge portion of HSU33147_PEA_1_P5 (SEQ ID NO:1415), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise EQ, having a structure as follows: a sequence starting from any of amino acid numbers 78-x to 78; and ending at any of amino acid numbers 79+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSU33147_PEA_1_1_P5 (SEQ ID NO:1415), as compared to the known protein Mammaglobin A precursor (SEQ ID NO:1416), are described in Table 1107 (given according to their position(s) on the amino acid sequence in the first column; the second column indicates whether the glycosylation site is present in the variant protein; and the last column indicates whether the position is different on the variant protein).

TABLE 1107

| Glycosylation site(s) | | |
| --- | --- | --- |
| Position(s) on known amino acid sequence | Present in variant protein? | Position in variant protein? |
| 68 | yes | 68 |
| 53 | yes | 53 |

Variant protein HSU33147_PEA_1_P5 (SEQ ID NO:1415) is encoded by the following transcript(s): HSU33147_PEA_1_T1 (SEQ ID NO:1464), for which the sequence(s) is/are given at the end of the application. The coding portion of transcript HSU33147_PEA_1_T1 (SEQ ID NO:1464) is shown in bold; this coding portion starts at position 72 and ends at position 341. The transcript also has the following SNPs as listed in Table 1108 (given according to their position on the nucleotide sequence, with the alternative nucleic acid listed; the last column indicates whether the SNP is known or not; the presence of known SNPs in variant protein HSU33147_PEA_1_P5 (SEQ ID NO:1415) sequence provides support for the deduced sequence of this variant protein according to the present invention).

TABLE 1108

| Nucleic acid SNPs | | |
| --- | --- | --- |
| SNP position on nucleotide sequence | Alternative nucleic acid | Previously known SNP? |
| 84 | A -> C | No |
| 124 | C -> | No |
| 396 | A -> G | No |

As noted above, cluster HSU33147 features 5 segment(s), which were listed in Table 1103 above and for which the sequence(s) are given at the end of the application. These segment(s) are portions of nucleic acid sequence(s) which are described herein separately because they are of particular interest. A description of each segment according to the present invention is now provided.

Segment cluster HSU33147_PEA_1_node_0 (SEQ ID NO:1276) according to the present invention is supported by 38 libraries. The number of libraries was determined as previously described. This segment can be found in the following transcript(s): HSU33147_PEA_1_T1 (SEQ ID NO:1464) and HSU33147_PEA_1_T2 (SEQ ID NO:1465). Table 1109 below describes the starting and ending position of this segment on each transcript.

TABLE 1109

| | Segment location on transcripts | |
| --- | --- | --- |
| Transcript name | Segment starting position | Segment ending position |
| HSU33147_PEA_1_T1 (SEQ ID NO:1464) | 1 | 126 |
| HSU33147_PEA_1_T2 (SEQ ID NO:1465) | 1 | 126 |

Segment cluster HSU33147_PEA_1_node_2 (SEQ ID NO:1277) according to the present invention is supported by 44 libraries. The number of libraries was determined as previously described. This segment can be found in the following transcript(s): HSU33147_PEA_1_T1 (SEQ ID NO:1464) and HSU33147_PEA_1_T2 (SEQ ID NO:1465). Table 1110 below describes the starting and ending position of this segment on each transcript.

TABLE 1110

| | Segment location on transcripts | |
| --- | --- | --- |
| Transcript name | Segment starting position | Segment ending position |
| HSU33147_PEA_1_T1 (SEQ ID NO:1464) | 127 | 305 |
| HSU33147_PEA_1_T2 (SEQ ID NO:1465) | 127 | 305 |

Segment cluster HSU33147_PEA_1_node_4 (SEQ ID NO:1278) according to the present invention is supported by 3 libraries. The number of libraries was determined as previously described. This segment can be found in the following transcript(s): HSU33147_PEA_1_T2 (SEQ ID NO:1465). Table 1111 below describes the starting and ending position of this segment on each transcript.

TABLE 1111

| | Segment location on transcripts | |
| --- | --- | --- |
| Transcript name | Segment starting position | Segment ending position |
| HSU33147_PEA_1_T2 (SEQ ID NO:1465) | 315 | 907 |

Segment cluster HSU33147_PEA_1_node_7 (SEQ ID NO:1279) according to the present invention is supported by 35 libraries. The number of libraries was determined as previously described. This segment can be found in the following transcript(s): HSU33147_PEA_1_T1 (SEQ ID NO:1464). Table 1112 below describes the starting and ending position of this segment on each transcript.

TABLE 1112

Segment location on transcripts

| Transcript name | Segment starting position | Segment ending position |
|---|---|---|
| HSU33147_PEA_1_T1 (SEQ ID NO:1464) | 306 | 516 |

According to an optional embodiment of the present invention, short segments related to the above cluster are also provided. These segments are up to about 120 bp in length, and so are included in a separate description.

Segment cluster HSU33147_PEA_1_node_3 (SEQ ID NO:1280) according to the present invention can be found in the following transcript(s): HSU33147_PEA_1_T2 (SEQ ID NO:1465). Table 1113 below describes the starting and ending position of this segment on each transcript.

TABLE 1113

Segment location on transcripts

| Transcript name | Segment starting position | Segment ending position |
|---|---|---|
| HSU33147_PEA_1_T2 (SEQ ID NO:1465) | 306 | 314 |

Variant protein alignment to the previously known protein:

Sequence name: MGBA_HUMAN (SEQ ID NO:1416)

Sequence documentation:

Alignment of: HSU33147_PEA_1_P5 (SEQ ID NO:1415) x MGBA_HUMAN (SEQ ID NO:1416) . . .

Alignment segment 1/1:

| | | | |
|---|---|---|---|
| Quality: | 776.00 | Escore: | 0 |
| Matching length: | 90 | Total length: | 93 |
| Matching Percent Similarity: | 100.00 | Matching Percent Identity: | 100.00 |
| Total Percent Similarity: | 96.77 | Total Percent Identity: | 96.77 |
| Gaps: | 1 | | |

Alignment:

```
  1 MKLLMVLMLAALSQHCYAGSGCPLLENVISKTINPQVSKTEYKELLQEFI  50
    |||||||||||||||||||||||||||||||||||||||||||||||||
  1 MKLLMVLMLAALSQHCYAGSGCPLLENVISKTINPQVSKTEYKELLQEFI  50

51 DDNATTNAIDELKECFLNQTDETLSNVE...QLIYDSSLCDLF         90
    |||||||||||||||||||||||||||   ||||||||||||
 51 DDNATTNAIDELKECFLNQTDETLSNVEVFMQLIYDSSLCDLF         93
```

Description for Cluster R20779

Cluster R20779 features 1 transcript(s) and 24 segment(s) of interest, the names for which are given in Tables 1114 and 1115, respectively, the sequences themselves are given at the end of the application. The selected protein variants are given in table 1116.

TABLE 1114

Transcripts of interest

| Transcript Name | Sequence ID No. |
|---|---|
| R20779_T7 | 134 |

TABLE 1115

Segments of interest

| Segment Name | Sequence ID No. |
|---|---|
| R20779_node_0 | 913 |
| R20779_node_2 | 914 |
| R20779_node_7 | 915 |
| R20779_node_9 | 916 |
| R20779_node_18 | 917 |
| R20779_node_21 | 918 |
| R20779_node_24 | 919 |
| R20779_node_27 | 920 |
| R20779_node_28 | 921 |
| R20779_node_30 | 922 |
| R20779_node_31 | 923 |
| R20779_node_32 | 924 |
| R20779_node_1 | 925 |
| R20779_node_3 | 926 |
| R20779_node_10 | 927 |
| R20779_node_11 | 928 |
| R20779_node_14 | 929 |
| R20779_node_17 | 930 |
| R20779_node_19 | 931 |
| R20779_node_20 | 932 |
| R20779_node_22 | 933 |
| R20779_node_23 | 934 |
| R20779_node_25 | 935 |
| R20779_node_29 | 936 |

TABLE 1116

Proteins of interest

| Protein Name | Sequence ID No. | Corresponding Transcript(s) |
|---|---|---|
| R20779_P2 | 1402 | R20779_T7 (SEQ ID NO:134) |

These sequences are variants of the known protein Stanniocalcin 2 precursor (SwissProt accession identifier STC2_HUMAN; known also according to the synonyms STC-2; Stanniocalcin-related protein; STCRP; STC-related protein), SEQ ID NO:1458, referred to herein as the previously known protein.

Protein Stanniocalcin 2 precursor (SEQ ID NO:1458) is known or believed to have the following function(s): Has an anti-hypocalcemic action on calcium and phosphate homeostasis. The sequence for protein Stanniocalcin 2 precursor is given at the end of the application, as "Stanniocalcin 2 precursor amino acid sequence". Protein Stanniocalcin 2 precursor localization is believed to be Secreted (Potential).

The following GO Annotation(s) apply to the previously known protein. The following annotation(s) were found: cell surface receptor linked signal transduction; cell-cell signaling; nutritional response pathway, which are annotation(s) related to Biological Process; hormone, which are annotation(s) related to Molecular Function; and extracellular, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster R20779 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 44 refer to weighted expression of ESTs in each category, as "parts per million" (ratio of the expression of ESTs for a particular cluster to the expression of all ESTs in that category, according to parts per million).

Figure 44:
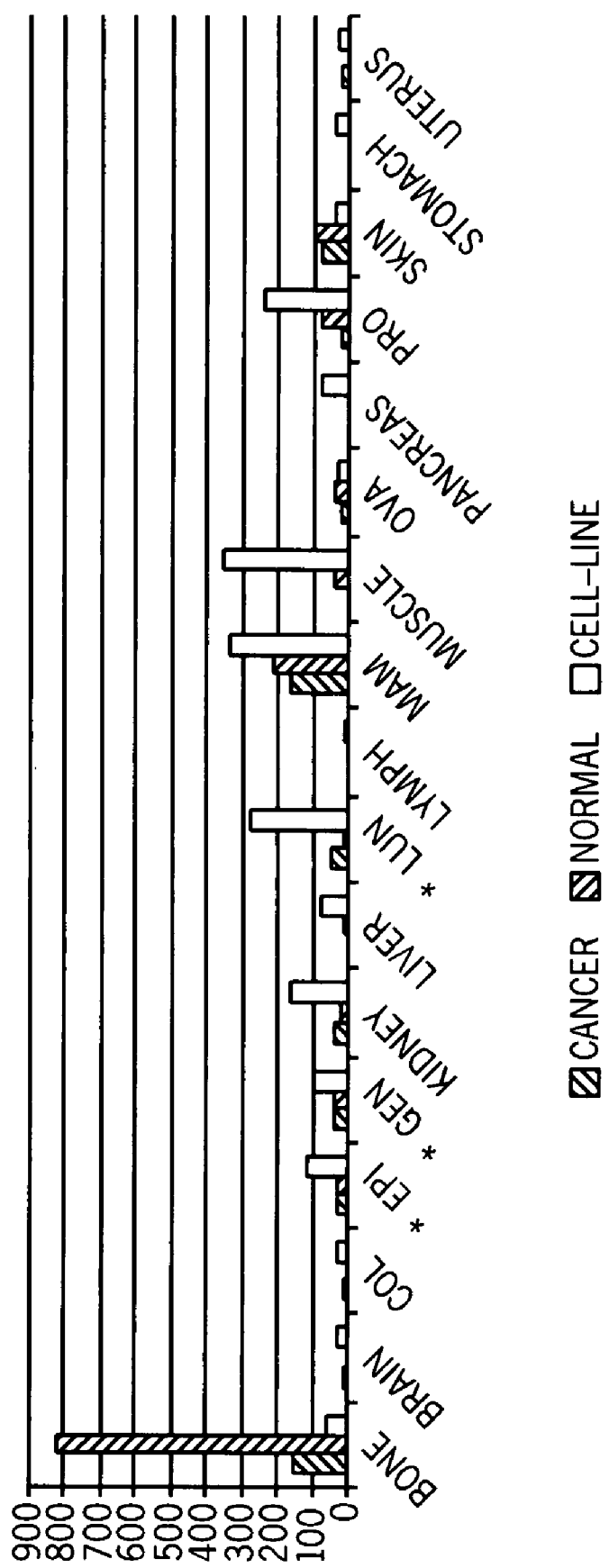
FIG. 44 is a histogram showing Cancer and cell-line vs. normal tissue expression for Cluster R20779, demonstrating overexpression in epithelial malignant tumors, a mixture of malignant tumors from different tissues and lung malignant tumors.

Overall, the following results were obtained as shown with regard to the histograms in FIG. 44 and Table 1117. This cluster is overexpressed (at least at a minimum level) in the following pathological conditions: epithelial malignant tumors, a mixture of malignant tumors from different tissues and lung malignant tumors.

TABLE 1117

Normal tissue distribution

| Name of Tissue | Number |
| --- | --- |
| bone | 825 |
| brain | 0 |
| colon | 0 |
| epithelial | 32 |
| general | 38 |
| kidney | 22 |
| liver | 9 |
| lung | 11 |
| lymph nodes | 0 |
| breast | 215 |
| muscle | 35 |
| ovary | 36 |
| pancreas | 4 |
| prostate | 80 |
| skin | 99 |
| stomach | 0 |
| uterus | 4 |

TABLE 1118

P values and ratios for expression in cancerous tissue

| Name of Tissue | P1 | P2 | SP1 | R3 | SP2 | R4 |
| --- | --- | --- | --- | --- | --- | --- |
| bone | 5.9e−01 | 7.4e−01 | 1 | 0.2 | 1 | 0.1 |
| brain | 2.5e−02 | 1.6e−02 | 2.2e−01 | 6.0 | 3.5e−02 | 8.0 |
| colon | 1.7e−01 | 1.7e−01 | 1 | 1.3 | 7.7e−01 | 1.5 |
| epithelial | 1.7e−01 | 1.5e−03 | 5.9e−01 | 1.0 | 2.0e−04 | 2.0 |
| general | 2.4e−02 | 6.2e−07 | 7.6e−01 | 0.8 | 4.6e−05 | 1.6 |
| kidney | 4.3e−01 | 2.7e−01 | 6.2e−01 | 1.3 | 1.5e−01 | 2.0 |
| liver | 8.3e−01 | 7.6e−01 | 1 | 0.8 | 3.3e−01 | 1.6 |
| lung | 1.2e−01 | 1.4e−03 | 1.9e−01 | 2.9 | 1.6e−05 | 7.7 |
| lymph nodes | 1 | 3.1e−01 | 1 | 1.0 | 1 | 1.4 |
| breast | 6.8e−01 | 6.8e−01 | 6.9e−01 | 0.8 | 3.6e−01 | 0.8 |
| muscle | 9.2e−01 | 4.8e−01 | 1 | 0.3 | 1.4e−03 | 1.4 |
| ovary | 8.4e−01 | 7.1e−01 | 9.0e−01 | 0.7 | 8.6e−01 | 0.8 |

TABLE 1118-continued

P values and ratios for expression in cancerous tissue

| Name of Tissue | P1 | P2 | SP1 | R3 | SP2 | R4 |
| --- | --- | --- | --- | --- | --- | --- |
| pancreas | 9.3e−01 | 6.8e−01 | 1 | 0.7 | 1.5e−01 | 2.0 |
| prostate | 9.1e−01 | 5.0e−01 | 9.8e−01 | 0.4 | 5.7e−01 | 0.7 |
| skin | 6.3e−01 | 7.5e−01 | 7.1e−01 | 0.8 | 9.5e−01 | 0.3 |
| stomach | 1 | 4.5e−01 | 1 | 1.0 | 5.1e−01 | 1.8 |
| uterus | 7.1e−01 | 2.6e−01 | 4.4e−01 | 1.7 | 4.1e−01 | 1.8 |

As noted above, cluster R20779 features 1 transcript(s), which were listed in Table 1114 above. These transcript(s) encode for protein(s) which are variant(s) of protein Stanniocalcin 2 precursor (SEQ ID NO:1458). A description of each variant protein according to the present invention is now provided.

Variant protein R20779_P2 (SEQ ID NO:1402) according to the present invention has an amino acid sequence as given at the end of the application; it is encoded by transcript(s) R20779_T7 (SEQ ID NO:134). An alignment is given to the known protein (Stanniocalcin 2 precursor (SEQ ID NO:1458)) at the end of the application. One or more alignments to one or more previously published protein sequences are given at the end of the application. A brief description of the relationship of the variant protein according to the present invention to each such aligned protein is as follows:

Comparison report between R20779_P2 (SEQ ID NO:1402) and STC2_HUMAN (SEQ ID NO:1458):

1. An isolated chimeric polypeptide encoding for R20779_P2 (SEQ ID NO:1402), comprising a first amino acid sequence being at least 90% homologous to MCAERLGQFMTLALVLATFDPARGTDATNPPEGPQDRSSQ-QKGRLSLQNTAEIQHCLVNAGDVGCGVFE CFENNS-CEIRGLHGICMTFLHNAGKFDAQGKSFIKDALKC-KAHALRHRFGCISRKCPAIREMVSQLQRECY LKHDL-CAAAQENTRVIVEMIHFKDLLLHE corresponding to amino acids 1-169 of STC2_HUMAN (SEQ ID NO:1458), which also corresponds to amino acids 1-169 of R20779_P2 (SEQ ID NO:1402), and a second amino acid sequence being at least 70%, optionally at least 80%, preferably at least 85%, more preferably at least 90% and most preferably at least 95% homologous to a polypeptide having the sequence CYKIEITMPKRRKVKLRD (SEQ ID NO: 270) corresponding to amino acids 170-187 of R20779_P2 (SEQ ID NO:1402), wherein said first amino acid sequence and second amino acid sequence are contiguous and in a sequential order.

2. An isolated polypeptide encoding for a tail of R20779_P2 (SEQ ID NO:1402), comprising a polypeptide being at least 70%, optionally at least about 80%, preferably at least about 85%, more preferably at least about 90% and most preferably at least about 95% homologous to the sequence CYKIEITMPKRRKVKLRD (SEQ ID NO: 270) in R20779P2 (SEQ ID NO:1402).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R20779_P2 (SEQ ID NO:1402) also has the following non-silent SNPs (Single Nucleotide Polymorphisms) as listed in Table 1119, (given according to their position(s) on the amino acid sequence, with the alternative amino acid(s) listed; the last column indicates whether the SNP is known or not; the presence of known SNPs in variant protein R20779_P2 (SEQ ID NO:1402) sequence provides support for the deduced sequence of this variant protein according to the present invention).

TABLE 1119

Amino acid mutations

| SNP position(s) on amino acid sequence | Alternative amino acid(s) | Previously known SNP? |
|---|---|---|
| 16 | L -> | No |
| 98 | Q -> | No |
| 171 | Y -> C | Yes |
| 177 | M -> V | Yes |

The glycosylation sites of variant protein R20779_P2 (SEQ ID NO:1402), as compared to the known protein Stanniocalcin 2 precursor (SEQ ID NO:1458), are described in Table 1120 (given according to their position(s) on the amino acid sequence in the first column; the second column indicates whether the glycosylation site is present in the variant protein; and the last column indicates whether the position is different on the variant protein).

TABLE 1120

Glycosylation site(s)

| Position(s) on known amino acid sequence | Present in variant protein? | Position in variant protein? |
|---|---|---|
| 73 | yes | 73 |

Variant protein R20779_P2 (SEQ ID NO:1402) is encoded by the following transcript(s): R20779_T7 (SEQ ID NO:134), for which the sequence(s) is/are given at the end of the application. The coding portion of transcript R20779_T7 (SEQ ID NO:134) is shown in bold; this coding portion starts at position 1397 and ends at position 1957. The transcript also has the following SNPs as listed in Table 1121 (given according to their position on the nucleotide sequence, with the alternative nucleic acid listed; the last column indicates whether the SNP is known or not; the presence of known SNPs in variant protein R20779_P2 (SEQ ID NO:1402) sequence provides support for the deduced sequence of this variant protein according to the present invention).

TABLE 1121

Nucleic acid SNPs

| SNP position on nucleotide sequence | Alternative nucleic acid | Previously known SNP? |
|---|---|---|
| 1442 | T -> | No |
| 1690 | G -> | No |
| 1732 | C -> T | Yes |
| 1867 | G -> T | Yes |
| 1908 | A -> G | Yes |
| 1925 | A -> G | Yes |
| 1968 | G -> A | Yes |
| 2087 | C -> T | No |
| 2138 | C -> T | Yes |
| 2270 | C -> | No |
| 2443 | A -> | No |

TABLE 1121-continued

Nucleic acid SNPs

| SNP position on nucleotide sequence | Alternative nucleic acid | Previously known SNP? |
|---|---|---|
| 2478 | G -> | No |
| 2479 | C -> A | No |
| 2616 | C -> A | No |
| 2941 | C -> | No |
| 3196 | -> A | No |
| 3479 | T -> G | Yes |
| 4290 | C -> T | Yes |
| 4358 | G -> A | Yes |
| 5363 | G -> A | No |

As noted above, cluster R20779 features 24 segment(s), which were listed in Table 1115 above and for which the sequence(s) are given at the end of the application. These segment(s) are portions of nucleic acid sequence(s) which are described herein separately because they are of particular interest. A description of each segment according to the present invention is now provided.

Segment cluster R20779_node_0 (SEQ ID NO:913) according to the present invention is supported by 31 libraries. The number of libraries was determined as previously described. This segment can be found in the following transcript(s): R20779_T7 (SEQ ID NO:134). Table 1122 below describes the starting and ending position of this segment on each transcript.

TABLE 1122

Segment location on transcripts

| Transcript name | Segment starting position | Segment ending position |
|---|---|---|
| R20779_T7 (SEQ ID NO:134) | 1 | 1298 |

Segment cluster R20779_node_2 (SEQ ID NO:914) according to the present invention is supported by 55 libraries. The number of libraries was determined as previously described. This segment can be found in the following transcript(s): R20779_T7 (SEQ ID NO:134). Table 1123 below describes the starting and ending position of this segment on each transcript.

TABLE 1123

Segment location on transcripts

| Transcript name | Segment starting position | Segment ending position |
|---|---|---|
| R20779_T7(SEQ ID NO:134) | 1337 | 1506 |

Segment cluster R20779_node_7 (SEQ ID NO:915) according to the present invention is supported by 63 libraries. The number of libraries was determined as previously described. This segment can be found in the following transcript(s): R20779_T7 (SEQ ID NO:134). Table 1124 below describes the starting and ending position of this segment on each transcript.

TABLE 1124

Segment location on transcripts

| Transcript name | Segment starting position | Segment ending position |
|---|---|---|
| R20779_T7(SEQ ID NO:134) | 1548 | 1690 |

Segment cluster R20779_node_9 (SEQ ID NO:916) according to the present invention is supported by 66 libraries. The number of libraries was determined as previously described. This segment can be found in the following transcript(s): R20779_T7 (SEQ ID NO:134). Table 1125 below describes the starting and ending position of this segment on each transcript.

TABLE 1125

Segment location on transcripts

| Transcript name | Segment starting position | Segment ending position |
|---|---|---|
| R20779_T7(SEQ ID NO:134) | 1691 | 1838 |

Segment cluster R20779_node_18 (SEQ ID NO:917) according to the present invention is supported by 61 libraries. The number of libraries was determined as previously described. This segment can be found in the following transcript(s): R20779_T7 (SEQ ID NO:134). Table 1126 below describes the starting and ending position of this segment on each transcript.

TABLE 1126

Segment location on transcripts

| Transcript name | Segment starting position | Segment ending position |
|---|---|---|
| R20779_T7(SEQ ID NO:134) | 2009 | 2176 |

Segment cluster R20779_node_21 (SEQ ID NO:918) according to the present invention is supported by 106 libraries. The number of libraries was determined as previously described: This segment can be found in the following transcript(s): R20779_T7 (SEQ ID NO:134). Table 1127 below describes the starting and ending position of this segment on each transcript.

TABLE 1127

Segment location on transcripts

| Transcript name | Segment starting position | Segment ending position |
|---|---|---|
| R20779_T7(SEQ ID NO:134) | 2219 | 2796 |

Segment cluster R20779_node_24 (SEQ ID NO:919) according to the present invention is supported by 100 libraries. The number of libraries was determined as previously described. This segment can be found in the following transcript(s): R20779_T7 (SEQ ID NO:134). Table 1128 below describes the starting and ending position of this segment on each transcript.

TABLE 1128

Segment location on transcripts

| Transcript name | Segment starting position | Segment ending position |
|---|---|---|
| R20779_T7(SEQ ID NO:134) | 2977 | 3667 |

Segment cluster R20779_node_27 (SEQ ID NO:920) according to the present invention is supported by 26 libraries. The number of libraries was determined as previously described. This segment can be found in the following transcript(s): R20779_T7 (SEQ ID NO:134). Table 1129 below describes the starting and ending position of this segment on each transcript.

TABLE 1129

Segment location on transcripts

| Transcript name | Segment starting position | Segment ending position |
|---|---|---|
| R20779_T7(SEQ ID NO:134) | 3673 | 3803 |

Segment cluster R20779_node_28 (SEQ ID NO:921) according to the present invention is supported by 31 libraries. The number of libraries was determined as previously described. This segment can be found in the following transcript(s): R20779_T7 (SEQ ID NO:134). Table 1130 below describes the starting and ending position of this segment on each transcript.

TABLE 1130

Segment location on transcripts

| Transcript name | Segment starting position | Segment ending position |
|---|---|---|
| R20779_T7(SEQ ID NO:134) | 3804 | 4050 |

Segment cluster R20779_node_30 (SEQ ID NO:922) according to the present invention is supported by 34 libraries. The number of libraries was determined as previously described. This segment can be found in the following transcript(s): R20779_T7 (SEQ ID NO:134). Table 1131 below describes the starting and ending position of this segment on each transcript.

TABLE 1131

Segment location on transcripts

| Transcript name | Segment starting position | Segment ending position |
|---|---|---|
| R20779_T7(SEQ ID NO:134) | 4068 | 4193 |

Segment cluster R20779_node_31 (SEQ ID NO:923) according to the present invention is supported by 46 libraries. The number of libraries was determined as previously described. This segment can be found in the following transcript(s): R20779_T7 (SEQ ID NO:134). Table 1132 below describes the starting and ending position of this segment on each transcript.

TABLE 1132

Segment location on transcripts

| Transcript name | Segment starting position | Segment ending position |
|---|---|---|
| R20779_T7(SEQ ID NO:134) | 4194 | 4424 |

Segment cluster R20779_node_32 (SEQ ID NO:924) according to the present invention is supported by 88 libraries. The number of libraries was determined as previously described. This segment can be found in the following transcript(s): R20779_T7 (SEQ ID NO:134). Table 1133 below describes the starting and ending position of this segment on each transcript.

TABLE 1133

Segment location on transcripts

| Transcript name | Segment starting position | Segment ending position |
|---|---|---|
| R20779_T7(SEQ ID NO:134) | 4425 | 5503 |

According to an optional embodiment of the present invention, short segments related to the above cluster are also provided. These segments are up to about 120 bp in length, and so are included in a separate description.

Segment cluster R20779_node_1 (SEQ ID NO:925) according to the present invention is supported by 27 libraries. The number of libraries was determined as previously described. This segment can be found in the following transcript(s): R20779_T7 (SEQ ID NO:134). Table 1134 below describes the starting and ending position of this segment on each transcript.

TABLE 1134

Segment location on transcripts

| Transcript name | Segment starting position | Segment ending position |
|---|---|---|
| R20779_T7(SEQ ID NO:134) | 1299 | 1336 |

Segment cluster R20779_node_3 (SEQ ID NO:926) according to the present invention is supported by 52 libraries. The number of libraries was determined as previously described. This segment can be found in the following transcript(s): R20779_T7 (SEQ ID NO:134). Table 1135 below describes the starting and ending position of this segment on each transcript.

TABLE 1135

Segment location on transcripts

| Transcript name | Segment starting position | Segment ending position |
|---|---|---|
| R20779_T7(SEQ ID NO:134) | 1507 | 1547 |

Segment cluster R20779_node_10 (SEQ ID NO:927) according to the present invention can be found in the following transcript(s): R20779_T7 (SEQ ID NO:134). Table 1136 below describes the starting and ending position of this segment on each transcript.

TABLE 1136

Segment location on transcripts

| Transcript name | Segment starting position | Segment ending position |
|---|---|---|
| R20779_T7(SEQ ID NO:134) | 1839 | 1849 |

Segment cluster R20779_node_11 (SEQ ID NO:928) according to the present invention is supported by 58 libraries. The number of libraries was determined as previously described. This segment can be found in the following transcript(s): R20779_T7 (SEQ ID NO:134). Table 1137 below describes the starting and ending position of this segment on each transcript.

TABLE 1137

Segment location on transcripts

| Transcript name | Segment starting position | Segment ending position |
|---|---|---|
| R20779_T7 (SEQ ID NO:134) | 1850 | 1902 |

Segment cluster R20779_node_14 (SEQ ID NO:929) according to the present invention is supported by 1 libraries. The number of libraries was determined as previously described. This segment can be found in the following transcript(s): R20779_T7 (SEQ ID NO:134). Table 1138 below describes the starting and ending position of this segment on each transcript.

TABLE 1138

Segment location on transcripts

| Transcript name | Segment starting position | Segment ending position |
|---|---|---|
| R20779_T7(SEQ ID NO:134) | 1903 | 1975 |

Segment cluster R20779_node_17 (SEQ ID NO:930) according to the present invention is supported by 54 libraries. The number of libraries was determined as previously described. This segment can be found in the following transcript(s): R20779_T7 (SEQ ID NO:134). Table 1139 below describes the starting and ending position of this segment on each transcript.

TABLE 1139

Segment location on transcripts

| Transcript name | Segment starting position | Segment ending position |
|---|---|---|
| R20779_T7(SEQ ID NO:134) | 1976 | 2008 |

Segment cluster R20779_node_19 (SEQ ID NO:931) according to the present invention can be found in the following transcript(s): R20779_T7 (SEQ ID NO:134). Table 1140 below describes the starting and ending position of this segment on each transcript.

TABLE 1140

| | Segment location on transcripts | |
|---|---|---|
| Transcript name | Segment starting position | Segment ending position |
| R20779_T7(SEQ ID NO:134) | 2177 | 2188 |

Segment cluster R20779_node_20 (SEQ ID NO:932) according to the present invention is supported by 53 libraries. The number of libraries was determined as previously described. This segment can be found in the following transcript(s): R20779_T7 (SEQ ID NO:134). Table 1141 below describes the starting and ending position of this segment on each transcript.

TABLE 1141

| | Segment location on transcripts | |
|---|---|---|
| Transcript name | Segment starting position | Segment ending position |
| R20779_T7(SEQ ID NO:134) | 2189 | 2218 |

Segment cluster R20779_node_22 (SEQ ID NO:933) according to the present invention is supported by 76 libraries. The number of libraries was determined as previously described. This segment can be found in the following transcript(s): R20779_T7 (SEQ ID NO:134). Table 1142 below describes the starting and ending position of this segment on each transcript.

TABLE 1142

| | Segment location on transcripts | |
|---|---|---|
| Transcript name | Segment starting position | Segment ending position |
| R20779_T7 (SEQ ID NO:134) | 2797 | 2899 |

Segment cluster R20779_node_23 (SEQ ID NO:934) according to the present invention is supported by 81 libraries. The number of libraries was determined as previously described. This segment can be found in the following transcript(s): R20779_T7 (SEQ ID NO:134). Table 1143 below describes the starting and ending position of this segment on each transcript.

TABLE 1143

| | Segment location on transcripts | |
|---|---|---|
| Transcript name | Segment starting position | Segment ending position |
| R20779_T7 (SEQ ID NO:134) | 2900 | 2976 |

Segment cluster R20779_node_25 (SEQ ID NO:935) according to the present invention can be found in the following transcript(s): R20779_T7 (SEQ ID NO:134). Table 1144 below describes the starting and ending position of this segment on each transcript.

TABLE 1144

| | Segment location on transcripts | |
|---|---|---|
| Transcript name | Segment starting position | Segment ending position |
| R20779_T7(SEQ ID NO:134) | 3668 | 3672 |

Segment cluster R20779_node_29 (SEQ ID NO:936) according to the present invention can be found in the following transcript(s): R20779_T7 (SEQ ID NO:134). Table 1145 below describes the starting and ending position of this segment on each transcript.

TABLE 1145

| | Segment location on transcripts | |
|---|---|---|
| Transcript name | Segment starting position | Segment ending position |
| R20779_T7(SEQ ID NO:134) | 4051 | 4067 |

Variant protein alignment to the previously known protein:

Sequence name: STC2_HUMAN (SEQ ID NO:1458)

Sequence documentation:

Alignment of: R20779_P2 (SEQ ID NO:1402) x STC2_HUMAN (SEQ ID NO:1458) . . .

Alignment segment 1/1:

| | |
|---|---|
| Quality: 1688.00 | Escore: 0 |
| Matching length: 171 | Total length: 171 |
| Matching Percent Similarity: 99.42 | Matching Percent Identity: 99.42 |
| Total Percent Similarity: 99.42 | Total Percent Identity: 99.42 |
| Gaps: 0 | |

Alignment:

```
  1  MCAERLGQFMTLALVLATFDPARGTDATNPPEGPQDRSSQQKGRLSLQNT  50
     ||||||||||||||||||||||||||||||||||||||||||||||||||
  1  MCAERLGQFMTLALVLATFDPARGTDATNPPEGPQDRSSQQKGRLSLQNT  50
```

```
 51 AEIQHCLVNAGDVGCGVFECFENNSCEIRGLHGICMTFLHNAGKFDAQGK 100
    |||||||||||||||||||||||||||||||||||||||||||||||||
 51 AEIQHCLVNAGDVGCGVFECFENNSCEIRGLHGICMTFLHNAGKFDAQGK 100

101 SFIKDALKCKAHALRHRFGCISRKCPAIREMVSQLQRECYLKHDLCAAAQ 150
    |||||||||||||||||||||||||||||||||||||||||||||||||
101 SFIKDALKCKAHALRHRFGCISRKCPAIREMVSQLQRECYLKHDLCAAAQ 150

151 ENTRVIVEMIHFKDLLLHECY 171
    ||||||||||||||||||| |
151 ENTRVIVEMIHFKDLLLHEPY 171
```

Description for Cluster R3814

Cluster R38144 features 6 transcript(s) and 24 segment(s) of interest, the names for which are given in Tables 1146 and 1147, respectively, the sequences themselves are given at the end of the application. The selected protein variants are given in table 1148.

TABLE 1146

Transcripts of interest

| Transcript Name | Sequence ID No. |
|---|---|
| R38144_PEA_2_T6 | 135 |
| R38144_PEA_2_T10 | 136 |
| R38144_PEA_2 T13 | 137 |
| R38144_PEA_2_T15 | 138 |
| R38144_PEA_2_T19 | 139 |
| R38144_PEA_2_T27 | 140 |

TABLE 1147

Segments of interest

| Segment Name | Sequence ID No. |
|---|---|
| R38144_PEA_2_node_21 | 937 |
| R38144_PEA_2_node_26 | 938 |
| R38144_PEA_2_node_29 | 939 |
| R38144_PEA_2_node_31 | 940 |
| R38144_PEA_2_node_46 | 941 |
| R38144_PEA_2_node_47 | 942 |
| R38144_PEA_2_node_49 | 943 |
| R38144_PEA_2_node_0 | 944 |
| R38144_PEA_2_node_1 | 945 |
| R38144_PEA_2_node_4 | 946 |
| R38144_PEA_2_node_5 | 947 |
| R38144_PEA_2_node_7 | 948 |
| R38144_PEA_2_node_11 | 949 |
| R38144_PEA_2_node_14 | 950 |
| R38144_PEA_2_node_15 | 951 |
| R38144_PEA_2_node_16 | 952 |
| R38144_PEA_2_node_19 | 953 |
| R38144_PEA_2_node_20 | 954 |
| R38144_PEA_2_node_36 | 955 |
| R38144_PEA_2_node_37 | 956 |
| R38144_PEA_2_node_43 | 957 |
| R38144_PEA_2_node_44 | 958 |
| R38144_PEA_2_node_45 | 959 |
| R38144_PEA_2_node_51 | 960 |

TABLE 1148

Proteins of interest

| Protein Name | Sequence ID No. | Corresponding Transcript(s) |
|---|---|---|
| R38144_PEA_2_P6 | 1403 | R38144_PEA_2_T6(SEQ ID NO:135) |
| R38144_PEA_2_P13 | 1404 | R38144_PEA_2_T13(SEQ ID NO:137) |
| R38144_PEA_2_P15 | 1405 | R38144_PEA_2_T15(SEQ ID NO:138) |
| R38144_PEA_2_P19 | 1406 | R38144_PEA_2_T19(SEQ ID NO:139) |
| R38144_PEA_2_P24 | 1407 | R38144_PEA_2_T27(SEQ ID NO:140) |
| R38144_PEA_2_P36 | 1408 | R38144_PEA_2_T10(SEQ ID NO:136) |

These sequences are variants of the known protein Putative alpha-mannosidase C20orf31 precursor (SwissProt accession identifier CT31_HUMAN; known also according to the synonyms EC 3.2.1), SEQ ID NO:1459, referred to herein as the previously known protein.

The sequence for protein Putative alpha-mannosidase C20orf31 precursor (SEQ ID NO:1459) is given at the end of the application, as "Putative alpha-mannosidase C20orf31 precursor amino acid sequence". Known polymorphisms for this sequence are as shown in Table 1149.

TABLE 1149

Amino acid mutations for Known Protein

| SNP position(s) on amino acid sequence | Comment |
|---|---|
| 456 | A -> T./FTId = VAR_012165. |
| 511 | S -> C |

Protein Putative alpha-mannosidase C20orf311 precursor (SEQ ID NO:1459) localization is believed to be Secreted (Potential).

The following GO Annotation(s) apply to the previously known protein. The following annotation(s) were found: carbohydrate metabolism; N-linked glycosylation, which are annotation(s) related to Biological Process; mannosyl-oligosaccharide 1,2-alpha-mannosidase; calcium binding; hydrolase, acting on glycosyl bonds, which are annotation(s)

related to Molecular Function; and membrane, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster R38144 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 45 refer to weighted expression of ESTs in each category, as "parts per million" (ratio of the expression of ESTs for a particular cluster to the expression of all ESTs in that category, according to parts per million).

Figure 45:
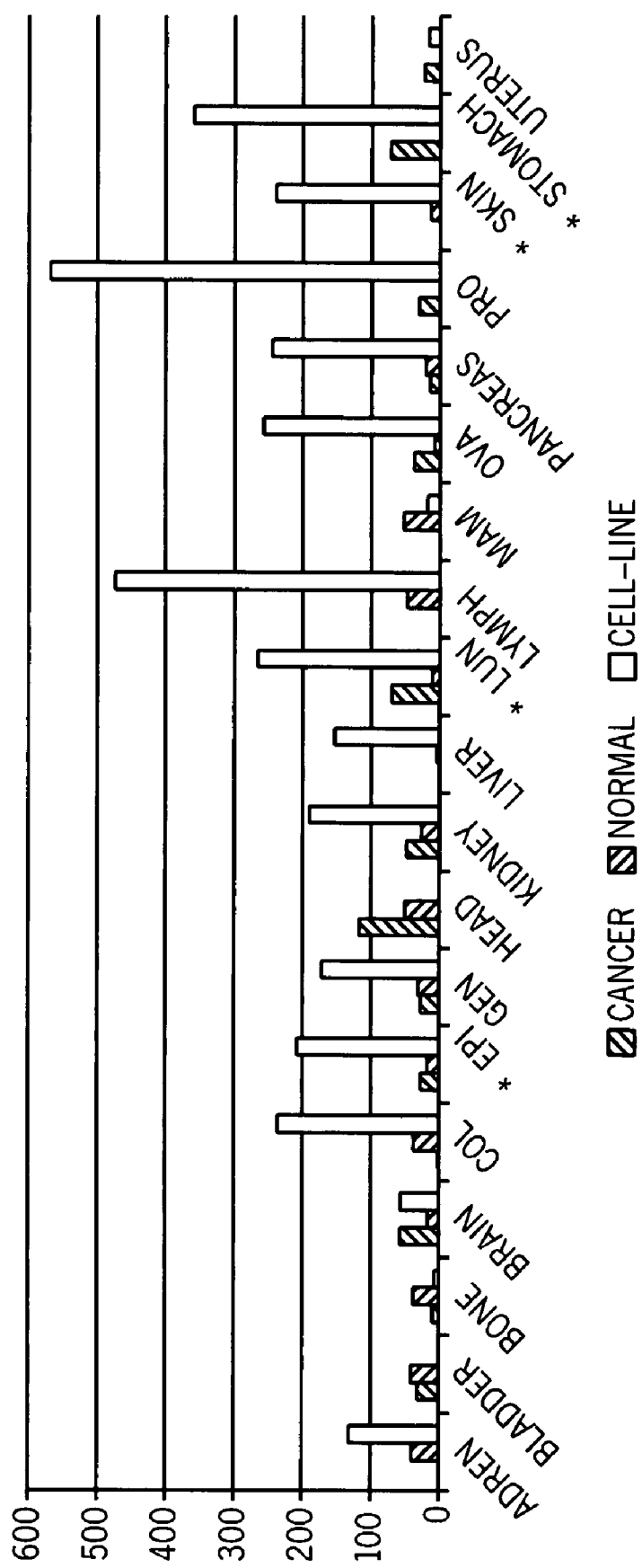
FIG. 45 is a histogram showing Cancer and cell-line vs. normal tissue expression for Cluster R38144, demonstrating overexpression in epithelial malignant tumors, lung malignant tumors, skin malignancies and gastric carcinoma.

Overall, the following results were obtained as shown with regard to the histograms in FIG. 45 and Table 1150. This cluster is overexpressed (at least at a minimum level) in the following pathological conditions: epithelial malignant tumors, lung malignant tumors, skin malignancies and gastric carcinoma.

TABLE 1150

Normal tissue distribution

| Name of Tissue | Number |
| --- | --- |
| Adrenal | 40 |
| Bladder | 41 |
| Bone | 38 |
| Brain | 16 |
| Colon | 37 |
| Epithelial | 18 |
| General | 31 |
| head and neck | 50 |
| Kidney | 26 |
| Liver | 4 |
| Lung | 11 |
| lymph nodes | 47 |
| Breast | 52 |
| Ovary | 7 |
| Pancreas | 20 |
| Prostate | 0 |
| Skin | 13 |
| Stomach | 0 |
| Uterus | 0 |

TABLE 1151

P values and ratios for expression in cancerous tissue

| Name of Tissue | P1 | P2 | SP1 | R3 | SP2 | R4 |
| --- | --- | --- | --- | --- | --- | --- |
| Adrenal | 9.2e−01 | 6.9e−01 | 1 | 0.5 | 7.8e−01 | 0.9 |
| Bladder | 7.6e−01 | 8.1e−01 | 8.1e−01 | 0.9 | 9.0e−01 | 0.7 |
| Bone | 6.6e−01 | 8.5e−01 | 1 | 0.6 | 1 | 0.6 |
| Brain | 8.0e−02 | 6.0e−02 | 4.7e−02 | 3.0 | 1.6e−02 | 3.0 |
| colon | 7.7e−01 | 7.5e−01 | 1 | 0.5 | 3.5e−01 | 0.8 |
| epithelial | 2.0e−01 | 4.8e−03 | 1.7e−01 | 1.4 | 2.7e−16 | 5.2 |
| general | 3.9e−01 | 2.2e−02 | 7.8e−01 | 0.9 | 2.1e−19 | 2.9 |
| head and neck | 3.4e−01 | 5.6e−01 | 4.6e−01 | 1.4 | 7.5e−01 | 0.9 |
| kidney | 8.3e−01 | 7.7e−01 | 4.4e−01 | 1.4 | 8.5e−02 | 1.6 |
| liver | 9.1e−01 | 6.0e−01 | 1 | 0.9 | 1.1e−01 | 1.8 |
| lung | 1.6e−02 | 1.5e−02 | 9.5e−02 | 3.8 | 1.6e−05 | 6.6 |
| lymph nodes | 7.1e−01 | 7.8e−01 | 1 | 0.3 | 1.2e−04 | 1.0 |
| breast | 9.1e−01 | 9.1e−01 | 1 | 0.5 | 9.7e−01 | 0.6 |
| ovary | 5.0e−01 | 2.9e−01 | 4.7e−01 | 1.7 | 7.0e−02 | 2.2 |
| pancreas | 7.2e−01 | 4.2e−01 | 8.1e−01 | 0.8 | 3.0e−02 | 1.8 |
| prostate | 7.9e−01 | 5.7e−01 | 3.0e−01 | 2.5 | 1.8e−01 | 3.0 |
| skin | 9.2e−01 | 8.7e−02 | 1 | 0.5 | 3.0e−05 | 4.1 |
| stomach | 3.0e−01 | 5.5e−02 | 2.5e−01 | 3.0 | 9.2e−04 | 6.1 |
| uterus | 2.1e−01 | 9.4e−02 | 4.4e−01 | 2.0 | 5.1e−01 | 1.9 |

As noted above, cluster R38144 features 6 transcript(s), which were listed in Table 1146 above. These transcript(s) encode for protein(s) which are variant(s) of protein Putative alpha-mannosidase C20orf31 precursor (SEQ ID NO:1459). A description of each variant protein according to the present invention is now provided.

Variant protein R38144_PEA_2_P6 (SEQ ID NO:1403) according to the present invention has an amino acid sequence as given at the end of the application; it is encoded by transcript(s) R38144_PEA_2_T6 (SEQ ID NO:135). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison report between R38144_PEA_2_P6 (SEQ ID NO:1403) and CT31_HUMAN (SEQ ID NO:1459):

1. An isolated chimeric polypeptide encoding for R38144_PEA_2_P6 (SEQ ID NO:1403), comprising a first amino acid sequence being at least 90% homologous to MPFRLLIPLGLLCALLPQHHGAPGPDGSAPDPAHY-RERVKAMFYHAYDSYLENAFPFDELRPLTCDGHDT WGSFSLTLIDALDTLLILGNVSEFQRVVEVLQDSV-DFDIDVNASVFETNIRVVGGLLSAHLLSKKAGVEVE AGWPCSGPLLRMAEEAARKLLPAFQTPTGMPYG-TVNLLHGVNPGETPVTCTAGIGTFIVEFATLSSLTGDP VFEDVARVALMRLWESRSDIGLVGNHIDVLTGKW-VAQDAGIGAGVDSYFEYLVKGAILLQDKKLMA-MF LEYNKAIRNYTRFDDWYLWVQMYKGTVSM-PVFQSLEAYWPGLQSLIGDIDNAMRTFLNYYT-VWKQFGG LPEFYNIPQGYTVEKREGYPLRPELI-ESAMYLYRATGDPTLLELGRDAVESIEKISKVECGFAT corresponding to amino acids 1-412 of CT31_HUMAN (SEQ ID NO:1459), which also corresponds to amino acids 1-412 of R38144_PEA_2_P6 (SEQ ID NO:1403), and a second amino acid sequence being at least 70%, optionally at least 80%, preferably at least 85%, more preferably at least 90% and most preferably at least 95% homologous to a polypeptide having the sequence LASFSHMSDQRSAR-PQAGQPHGVVLPGRDCEIPLPPV (SEQ ID NO: 268) corresponding to amino acids 413-449 of R38144_PEA_2_P6 (SEQ ID NO:1403), wherein said first amino acid sequence and second amino acid sequence are contiguous and in a sequential order.

2. An isolated polypeptide encoding for a tail of R38144_PEA_2_P6 (SEQ ID NO:1403), comprising a polypeptide being at least 70%, optionally at least about 80%, preferably at least about 85%, more preferably at least about 90% and most preferably at least about 95% homologous to the sequence LASFSHMSDQRSARPQAGQPHGVV-LPGRDCEIPLPPV (SEQ ID NO: 268) in R38144_PEA_2_P6 (SEQ ID NO:1403).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P6 (SEQ ID NO:1403) also has the following non-silent SNPs (Single Nucleotide Polymorphisms) as listed in Table 1152, (given according to their position(s) on the amino acid sequence, with the alternative amino acid(s) listed; the last column indicates whether the SNP is known or not; the presence of known SNPs in variant protein R38144_PEA_2_P6 (SEQ ID NO:1403) sequence provides support for the deduced sequence of this variant protein according to the present invention).

TABLE 1152

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 346 | F -> | No |

The glycosylation sites of variant protein R38144_PEA_2_P6 (SEQ ID NO:1403), as compared to the known protein Putative alpha-mannosidase C20orf31 precursor (SEQ ID NO:1459), are described in Table 1153 (given according to their position(s) on the amino acid sequence in the first column; the second column indicates whether the glycosylation site is present in the variant protein; and the last column indicates whether the position is different on the variant protein).

TABLE 1153

Glycosylation site(s)

| Position(s) on known amino acid sequence | Present in variant protein? | Position in variant protein? |
|---|---|---|
| 450 | no | |
| 289 | yes | 289 |
| 112 | yes | 112 |
| 90 | yes | 90 |

Variant protein R38144_PEA_2_P6 (SEQ ID NO:1403) is encoded by the following transcript(s): R38144_PEA_2_T6 (SEQ ID NO:135), for which the sequence(s) is/are given at the end of the application. The coding portion of transcript R38144_PEA_2_T6 (SEQ ID NO:135) is shown in bold; this coding portion starts at position 91 and ends at position 1437. The transcript also has the following SNPs as listed in Table 1154 (given according to their position on the nucleotide sequence, with the alternative nucleic acid listed; the last column indicates whether the SNP is known or not; the presence of known SNPs in variant protein R38144_PEA_2_P6 (SEQ ID NO:1403) sequence provides support for the deduced sequence of this variant protein according to the present invention).

TABLE 1154

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1126 | T -> | No |
| 1218 | C -> T | Yes |
| 1392 | A -> G | No |
| 1425 | T -> C | No |
| 1481 | G -> A | Yes |
| 1560 | C -> T | No |
| 1566 | C -> | No |
| 1644 | G -> A | Yes |
| 1646 | A -> T | No |
| 1763 | A -> | No |
| 1763 | A -> C | No |
| 1781 | C -> T | Yes |
| 1799 | C -> | No |
| 1799 | C -> G | No |
| 1844 | T -> G | No |
| 1855 | A -> C | Yes |

Variant protein R38144_PEA_2_P13 (SEQ ID NO:1404) according to the present invention has an amino acid sequence as given at the end of the application; it is encoded by transcript(s) R38144_PEA_2_T13 (SEQ ID NO:137). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison report between R38144_PEA_2_P13 (SEQ ID NO:1404) and CT31_HUMAN (SEQ ID NO:1459):

1. An isolated chimeric polypeptide encoding for R38144_PEA_2_P13 (SEQ ID NO:1404), comprising a first amino acid sequence being at least 90% homologous to MPFRLLIPLGLLCALLPQHHGAPGPDGSAPDPAH-YRERVKAMFYHAYDSYLENAFPFDELRPLTCDGHDT WGSFSLTLIDALDTLLILGNVSEFQRVVEVLQDSV-DFDIDVNASVFETNIRVVGGLLSAHLLSKKAGVEVE AGWPCSGPLLRMAEEAARKLLPAFQTPTGMPYG-TVNLLHGVNPGETPVTCTAGIGTFIVEFATLSSLTGDP VFEDVARVALMRLWESRSDIGLVGNHIDVLTGKWV-AQDAGIGAGVDSYFEYLVKGAILLQDKKLMAMF LEYNKAIRNYTRFDDWYLWVQMYKGTVSMPVFQ-SLEAYWPGLQ corresponding to amino acids 1-323 of CT31_HUMAN (SEQ ID NO:1459), which also corresponds to amino acids 1-323 of R38144_PEA_2_P13 (SEQ ID NO:1404), and a second amino acid sequence being at least 70%, optionally at least 80%, preferably at least 85%, more preferably at least 90% and most preferably at least 95% homologous to a polypeptide having the sequence NLLKAQCTSTVPRGIPPS (SEQ ID NO: 269) corresponding to amino acids 324-341 of R38144_PEA_2_P13 (SEQ ID NO:1404), wherein said first amino acid sequence and second amino acid sequence are contiguous and in a sequential order.

2. An isolated polypeptide encoding for a tail of R38144_PEA_2_P13 (SEQ ID NO:1404), comprising a polypeptide being at least 70%, optionally at least about 80%, preferably at least about 85%, more preferably at least about 90% and most preferably at least about 95% homologous to the sequence NLLKAQCTSTVPRGIPPS (SEQ ID NO: 269) in R38144_PEA_2_P13 (SEQ ID NO:1404).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P13 (SEQ ID NO:1404) also has the following non-silent SNPs (Single Nucleotide Polymorphisms) as listed in Table 1155, (given according to their position(s) on the amino acid sequence, with the alternative amino acid(s) listed; the last column indicates whether the SNP is known or not; the presence of known SNPs invariant protein R38144_PEA_2_P13 (SEQ ID NO:1404) sequence provides support for the deduced sequence of this variant protein according to the present invention).

TABLE 1155

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 328 | A -> V | Yes |

The glycosylation sites of variant protein R38144_PEA_2_P13 (SEQ ID NO:1404), as compared to the known protein Putative alpha-mannosidase C20orf31 precursor (SEQ ID NO:1459), are described in Table 1156 (given according to their position(s) on the amino acid sequence in the first column; the second column indicates whether the glycosylation site is present in the variant protein; and the last column indicates whether the position is different on the variant protein).

TABLE 1156

Glycosylation site(s)

| Position(s) on known amino acid sequence | Present in variant protein? | Position in variant protein? |
|---|---|---|
| 450 | no | |
| 289 | yes | 289 |
| 112 | yes | 112 |
| 90 | yes | 90 |

Variant protein R38144_PEA_2_P13 (SEQ ID NO:1404) is encoded by the following transcript(s): R38144_PEA_2_T13 (SEQ ID NO:137), for which the sequence(s) is/are given at the end of the application. The coding portion of transcript R38144_PEA_2_T13 (SEQ ID NO:137) is shown in bold; this coding portion starts at position 91 and ends at position 1113. The transcript also has the following SNPs as listed in Table 1157 (given according to their position on the nucleotide sequence, with the alternative nucleic acid listed; the last column indicates whether the SNP is known or not; the presence of known SNPs in variant protein R38144_PEA_2_P13 (SEQ ID NO:1404) sequence provides support for the deduced sequence of this variant protein according to the present invention).

TABLE 1157

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1073 | C -> T | Yes |
| 1222 | A -> G | No |
| 1255 | T -> C | No |
| 1311 | G -> A | Yes |
| 1390 | C -> T | No |
| 1396 | C -> | No |
| 1474 | G -> A | Yes |
| 1476 | A -> T | No |
| 1593 | A -> | No |
| 1593 | A -> C | No |
| 1611 | C -> T | Yes |
| 1629 | C -> | No |
| 1629 | C -> G | No |
| 1674 | T -> G | No |
| 1685 | A -> C | Yes |

Variant protein R38144_PEA_2_P15 (SEQ ID NO:1405) according to the present invention has an amino acid sequence as given at the end of the application; it is encoded by transcript(s) R38144_PEA_2_T15 (SEQ ID NO:138). An alignment is given to the known protein (Putative alpha-mannosidase C20 orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison report between R38144_PEA_2_P15 (SEQ ID NO:1405) and CT31_HUMAN (SEQ ID NO:1459):

1. An isolated chimeric polypeptide encoding for R38144_PEA_2_P15 (SEQ ID NO:1405), comprising a first amino acid sequence being at least 90% homologous to MPFRLLIPLGLLCALLPQHHGAPGPDGSAPDPAHYR-ERVKAMFYHAYDSYLENAFPFDELRPLTCDGHDT WGSFSLTLIDALDTLLILGNVSEFQRVVEVLQDSVDF-DIDVNASVFETNIRVVGGLLSAHLLSKKAGVEVE AGWPCSGPLLRMAEEAARKLLPAFQTPTGMPYG-TVNLLHGVNPGETPVTCTAGIGTFIVEFATLSSLTGDP VFEDVARVALMRLWESRSDIGLVGNHIDVLTGKW-VAQDAGIGAGVDSYFEYLVKGAILLQDKKLMAMF LE corresponding to amino acids 1-282 of CT31_HUMAN (SEQ ID NO:1459), which also corresponds to amino acids 1-282 of R38144_PEA_2_P15 (SEQ ID NO:1405), and a second amino acid sequence being at least 70%, optionally at least 80%, preferably at least 85%, more preferably at least 90% and most preferably at least 95% homologous to a polypeptide having the sequence PHWRH (SEQ ID NO: 270) corresponding to amino acids 283-287 of R38144_PEA_2_P15 (SEQ ID NO:1405), wherein said first amino acid sequence and second amino acid sequence are contiguous and in a sequential order.

2. An isolated polypeptide encoding for a tail of R38144_PEA_2_P15 (SEQ ID NO:1405), comprising a polypeptide being at least 70%, optionally at least about 80%, preferably at least about 85%, more preferably at least about 90% and most preferably at least about 95% homologous to the sequence PHWRH (SEQ ID NO: 270) in R38144_PEA_2_P15 (SEQ ID NO:1405).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P15 (SEQ ID NO:1405) also has the following non-silent SNPs (Single Nucleotide Polymorphisms) as listed in Table 1158, (given according to their position(s) on the amino acid sequence, with the alternative amino acid(s) listed; the last column indicates whether the SNP is known or not; the presence of known SNPs in variant protein R38144_PEA_2_P15 (SEQ ID NO:1405) sequence provides support for the deduced sequence of this variant protein according to the present invention).

TABLE 1158

Amino acid mutations

| SNP position(s) on amino acid sequence | Alternative amino acid(s) | Previously known SNP? |
|---|---|---|
| 10 | G –> | No |
| 54 | A –> V | Yes |
| 55 | F –> L | Yes |
| 73 | S –> I | Yes |
| 87 | I –> | No |
| 145 | P –> | No |
| 145 | P –> A | No |
| 164 | A –> G | No |
| 164 | A –> | No |
| 203 | A –> G | No |
| 203 | A –> | No |
| 211 | D –> | No |
| 236 | G –> | No |
| 265 | V –> G | No |

The glycosylation sites of variant protein R38144_PEA_2_P15 (SEQ ID NO:1405), as compared to the known protein Putative alpha-mannosidase C20orf31 precursor (SEQ ID NO:1459), are described in Table 1159 (given according to their position(s) on the amino acid sequence in the first column; the second column indicates whether the glycosylation site is present in the variant protein; and the last column indicates whether the position is different on the variant protein).

TABLE 1159

Glycosylation site(s)

| Position(s) on known amino acid sequence | Present in variant protein? | Position in variant protein? |
|---|---|---|
| 450 | no | |
| 289 | no | |
| 112 | yes | 112 |
| 90 | yes | 90 |

Variant protein R38144_PEA_2_P15 (SEQ ID NO:1405) is encoded by the following transcript(s): R38144_PEA_2_T15 (SEQ ID NO:138), for which the sequence(s) is/are given at the end of the application. The coding portion of transcript R38144_PEA_2_T15 (SEQ ID NO:138) is shown in bold; this coding portion starts at position 91 and ends at position 951. The transcript also has the following SNPs as listed in Table 1160 (given according to their position on the nucleotide sequence, with the alternative nucleic acid listed; the last column indicates whether the SNP is known or not; the presence of known SNPs in variant protein R38144_PEA_2_P15 (SEQ ID NO:1405) sequence provides support for the deduced sequence of this variant protein according to the present invention).

TABLE 1160

Nucleic acid SNPs

| SNP position on nucleotide sequence | Alternative nucleic acid | Previously known SNP? |
|---|---|---|
| 120 | C –> | No |
| 251 | C –> T | Yes |
| 253 | T –> C | Yes |
| 308 | G –> T | Yes |
| 312 | T –> C | No |
| 350 | T –> | No |

TABLE 1160-continued

Nucleic acid SNPs

| SNP position on nucleotide sequence | Alternative nucleic acid | Previously known SNP? |
|---|---|---|
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 1001 | T -> | No |
| 1093 | C -> T | Yes |
| 1242 | A -> G | No |
| 1275 | T -> C | No |
| 1331 | G -> A | Yes |
| 1410 | C -> T | No |
| 1416 | C -> | No |
| 1494 | G -> A | Yes |
| 1496 | A -> T | No |
| 1613 | A -> | No |
| 1613 | A -> C | No |
| 1631 | C -> T | Yes |
| 1649 | C -> | No |
| 1649 | C -> G | No |
| 1694 | T -> G | No |
| 1705 | A -> C | Yes |

Variant protein R38144_PEA_2_P19 (SEQ ID NO:1406) according to the present invention has an amino acid sequence as given at the end of the application; it is encoded by transcript(s) R38144_PEA_2_T19 (SEQ ID NO:139). An alignment is given to the known protein (Putative alpha-mannosidase C20orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison report between R38144_PEA_2_P19 (SEQ ID NO:1406) and CT31_HUMAN (SEQ ID NO:1459):

1. An isolated chimeric polypeptide encoding for R38144_PEA_2_P19 (SEQ ID NO:1406), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIRVVGGLL-SAHLLSKKAGVEVE AGWPCSGPLLRMAEEAARKLL-PAFQTPTGMPYGTVNLLHGVNPGET-PVTCTAGIGTFIVEFATLSSLTGDP VFEDVARVALMRL-WESRSDIGLVGNHIDVLTGKWVAQDAGIGAGVDSYF-EYLVKGAILLQDKKLMAMF LEYNKAIRNYTRFD-DWYLWVQMYKGTVSMPVFQSLEAYW-PGLQSLIGDIDNAMRTFLNYYTVWKQFGG LPE-FYNIPQGYTVEKREGYPLRPELIESAMYLYRATGDPT-LLELGRDAVESIEKISKVECGFAT corresponding to amino acids 1-412 of CT31_HUMAN (SEQ ID NO:1459), which also corresponds to amino acids 1-412 of R38144_PEA_2_P19 (SEQ ID NO:1406), and a second amino acid sequence being at least 70%, optionally at least 80%, preferably at least 85%, more preferably at least 90% and most preferably at least 95% homologous to a polypeptide having the sequence KRSRSVAQAGVQWCDHDSPQP (SEQ ID NO: 270) corresponding to amino acids 413-433 of R38144_PEA_2_P19 (SEQ ID NO:1406), wherein said first amino acid sequence and second amino acid sequence are contiguous and in a sequential order.

2. An isolated polypeptide encoding for a tail of R38144_PEA_2_P19 (SEQ ID NO:1406), comprising a polypeptide being at least 70%, optionally at least about 80%, preferably at least about 85%, more preferably at least about 90% and most preferably at least about 95% homologous to the sequence KRSRSVAQAGVQWCDHDSPQP (SEQ ID NO: 270) in R38144_PEA_2_P19 (SEQ ID NO:1406).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P19 (SEQ ID NO:1406) also has the following non-silent SNPs (Single Nucleotide Polymorphisms) as listed in Table 1161, (given according to their position(s) on the amino acid sequence, with the alternative amino acid(s) listed; the last column indicates whether the SNP is known or not; the presence of known SNPs in variant protein R38144_PEA_2_P19 (SEQ ID NO:1406) sequence provides support for the deduced sequence of this variant protein according to the present invention).

TABLE 1161

Amino acid mutations

| SNP position(s) on amino acid sequence | Alternative amino acid(s) | Previously known SNP? |
|---|---|---|
| 10 | G -> | No |
| 54 | A -> V | Yes |
| 55 | F -> L | Yes |
| 73 | S -> I | Yes |
| 87 | I -> | No |
| 145 | P -> | No |
| 145 | P -> A | No |
| 164 | A -> G | No |
| 164 | A -> | No |
| 203 | A -> G | No |
| 203 | A -> | No |
| 211 | D -> | No |
| 236 | G -> | No |
| 265 | V -> G | No |
| 285 | K -> | No |
| 294 | D -> N | No |
| 305 | G -> E | No |
| 323 | Q -> R | No |
| 346 | F -> | No |

The glycosylation sites of variant protein R38144_PEA_2_P19 (SEQ ID NO:1406), as compared to the known protein Putative alpha-mannosidase C20orf31 precursor (SEQ ID NO:1459), are described in Table 1162 (given according to their position(s) on the amino acid sequence in the first column; the second column indicates whether the glycosylation site is present in the variant protein; and the last column indicates whether the position is different on the variant protein).

TABLE 1162

| Glycosylation site(s) | | |
|---|---|---|
| Position(s) on known amino acid sequence | Present in variant protein? | Position in variant protein? |
| 450 | no | |
| 289 | yes | 289 |
| 112 | yes | 112 |
| 90 | yes | 90 |

Variant protein R38144_PEA_2_P19 (SEQ ID NO:1406) is encoded by the following transcript(s): R38144_PEA_2_T19 (SEQ ID NO:139), for which the sequence(s) is/are given at the end of the application. The coding portion of transcript R38144_PEA_2_T19 (SEQ ID NO:139) is shown in bold; this coding portion starts at position 91 and ends at position 1389. The transcript also has the following SNPs as listed in Table 1163 (given according to their position on the nucleotide sequence, with the alternative nucleic acid listed; the last column indicates whether the SNP is known or not; the presence of known SNPs in variant protein R38144_PEA_2_P19 (SEQ ID NO:1406) sequence provides support for the deduced sequence of this variant protein according to the present invention).

TABLE 1163

| Nucleic acid SNPs | | |
|---|---|---|
| SNP position on nucleotide sequence | Alternative nucleic acid | Previously known SNP? |
| 120 | C -> | No |
| 251 | C -> T | Yes |
| 253 | T -> C | Yes |
| 308 | G -> T | Yes |
| 312 | T -> C | No |
| 350 | T -> | No |
| 523 | C -> | No |
| 523 | C -> G | No |
| 581 | C -> | No |
| 581 | C -> G | No |
| 698 | C -> | No |
| 698 | C -> G | No |
| 723 | C -> | No |
| 798 | C -> | No |
| 798 | C -> G | No |
| 849 | -> C | No |
| 849 | -> G | No |
| 884 | T -> G | No |
| 901 | -> C | No |
| 901 | -> T | No |
| 943 | A -> | No |
| 970 | G -> A | No |
| 1004 | G -> A | No |
| 1058 | A -> G | No |
| 1126 | T -> | No |
| 1218 | C -> T | Yes |
| 1446 | C -> | Yes |

Variant protein R38144_PEA_2_P24 (SEQ ID NO:1407) according to the present invention has an amino acid sequence as given at the end of the application; it is encoded by transcript(s) R38144_PEA_2_T27 (SEQ ID NO:140). An alignment is given to the known protein (Putative alpha-mannosidase C20 orf31 precursor (SEQ ID NO:1459)) at the end of the application. One or more alignments to one or more previously published protein sequences are given at the end of the application. A brief description of the relationship of the variant protein according to the present invention to each such aligned protein is as follows:

Comparison report between R38144_PEA_2_P24 (SEQ ID NO:1407) and CT31_HUMAN (SEQ ID NO:1459):

1. An isolated chimeric polypeptide encoding for R38144_PEA_2_P24 (SEQ ID NO:1407), comprising a first amino acid sequence being at least 90% homologous to MPFRLLIPLGLLCALLPQHHGAPGPDG-SAPDPAHYRERVKAMFYHAYDSYLENAF-PFDELRPLTCDGHDT WGSFSLTLIDALDTLLILGN-VSEFQRVVEVLQDSVDFDIDVNASVFETNIR corresponding to amino acids 1-121 of CT31_HUMAN (SEQ ID NO:1459), which also corresponds to amino acids 1-121 of R38144_PEA_2_P24 (SEQ ID NO:1407), and a second amino acid sequence being at least 90% homologous to EYNKAIRNYTRFDDWYLWVQMYKGTVSMPV-FQSLEAYWPGLQSLIGDIDNAMRTFLNYYTVWK-QFGGL PEFYNIPQGYTVEKREGYPLRPELIESA-MYLYRATGDPTLLELGRDAVESIEKISKVECGFATI-KDLRDHKL DNRMESFFLAETVKYLYLLFDPTN-FIHNNGSTFDAVITPYGECILGAGGYIFNTEAHPID-PAALHCCQRLKE EQWEVEDLMREFYSLKRSR-SKFQKNTVSSGPWEPPARPGTLFSPENHDQARER-KPAKQKVPLLSCPSQPFT SKLALLGQVFLDSS corresponding to amino acids 282-578 of CT31_HUMAN (SEQ ID NO:1459), which also corresponds to amino acids 122-418 of R38144_PEA_2_P24 (SEQ ID NO:1407), wherein said first amino acid sequence and second amino acid sequence are contiguous and in a sequential order.

2. An isolated chimeric polypeptide encoding for an edge portion of R38144_PEA_2_P24 (SEQ ID NO:1407), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise RE, having a structure as follows: a sequence starting from any of amino acid numbers 121-x to 121; and ending at any of amino acid numbers 122+((n−2)−x), in which x varies from 0 to n−2.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P24 (SEQ ID NO:1407) also has the following non-silent SNPs (Single Nucleotide Polymorphisms) as listed in Table 1164, (given according to their position(s) on the amino acid sequence, with the alternative amino acid(s) listed; the last column indicates whether the SNP is known or not; the presence of known SNPs in variant protein R38144_PEA_2_P24 (SEQ ID NO:1407) sequence provides support for the deduced sequence of this variant protein according to the present invention).

TABLE 1164

| Amino acid mutations | | |
|---|---|---|
| SNP position(s) on amino acid sequence | Alternative amino acid(s) | Previously known SNP? |
| 10 | G -> | No |
| 54 | A -> V | Yes |

TABLE 1164-continued

Amino acid mutations

| SNP position(s) on amino acid sequence | Alternative amino acid(s) | Previously known SNP? |
|---|---|---|
| 55 | F -> L | Yes |
| 73 | S -> I | Yes |
| 87 | I -> | No |
| 125 | K -> | No |
| 134 | D -> N | No |
| 145 | G -> E | No |
| 163 | Q -> R | No |
| 186 | F -> | No |
| 266 | E -> G | No |
| 277 | L -> P | No |
| 296 | A -> T | Yes |
| 322 | P -> L | No |
| 324 | A -> | No |
| 350 | R -> Q | Yes |
| 351 | S -> C | No |
| 390 | K -> | No |
| 390 | K -> Q | No |
| 396 | L -> F | Yes |
| 402 | P -> | No |
| 402 | P -> A | No |
| 417 | S -> A | No |

The glycosylation sites of variant protein R38144PEA_2_P24 (SEQ ID NO:1407), as compared to the known protein Putative alpha-mannosidase C20orf31 precursor (SEQ ID NO:1459), are described in Table 1165 (given according to their position(s) on the amino acid sequence in the first column; the second column indicates whether the glycosylation site is present in the variant protein; and the last column indicates whether the position is different on the variant protein).

TABLE 1165

Glycosylation site(s)

| Position(s) on known amino acid sequence | Present in variant protein? | Position in variant protein? |
|---|---|---|
| 450 | yes | 290 |
| 289 | yes | 129 |
| 112 | yes | 112 |
| 90 | yes | 90 |

Variant protein R38144_PEA_2_P24 (SEQ ID NO:1407) is encoded by the following transcript(s): R38144_PEA_2_T27 (SEQ ID NO:140), for which the sequence(s) is/are given at the end of the application. The coding portion of transcript R38144_PEA_2_T27 (SEQ ID NO:140) is shown in bold; this coding portion starts at position 91 and ends at position 1344. The transcript also has the following SNPs as listed in Table 1166 (given according to their position on the nucleotide sequence, with the alternative nucleic acid listed; the last column indicates whether the SNP is known or not; the presence of known SNPs in variant protein R38144_PEA_2_P24 (SEQ ID NO:1407) sequence provides support for the deduced sequence of this variant protein according to the present invention).

TABLE 1166

Nucleic acid SNPs

| SNP position on nucleotide sequence | Alternative nucleic acid | Previously known SNP? |
|---|---|---|
| 120 | C -> | No |
| 251 | C -> T | Yes |
| 253 | T -> C | Yes |
| 308 | G -> T | Yes |
| 312 | T -> C | No |
| 350 | T -> | No |
| 463 | A -> | No |
| 490 | G -> A | No |
| 524 | G -> A | No |
| 578 | A -> G | No |
| 646 | T -> | No |
| 738 | C -> T | Yes |
| 887 | A -> G | No |
| 920 | T -> C | No |
| 976 | G -> A | Yes |
| 1055 | C -> T | No |
| 1061 | C -> | No |
| 1139 | G -> A | Yes |
| 1141 | A -> T | No |
| 1258 | A -> | No |
| 1258 | A -> C | No |
| 1276 | C -> T | Yes |
| 1294 | C -> | No |
| 1294 | C -> G | No |
| 1339 | T -> G | No |
| 1350 | A -> C | Yes |

Variant protein R38144_PEA_2_P36 (SEQ ID NO:1408) according to the present invention has an amino acid sequence as given at the end of the application; it is encoded by transcript(s) R38144_PEA_2_T10 (SEQ ID NO:136). An alignment is given to the known protein (Putative alpha-mannosidase C20orf31 precursor (SEQ ID NO:1459); SEQ ID NO:1459) at the end of the application. One or more alignments to one or more previously published protein sequences are given at the end of the application. A brief description of the relationship of the variant protein according to the present invention to each such aligned protein is as follows:

Comparison report between R38144_PEA_2_P36 (SEQ ID NO:1408) and AAH16184 (SEQ ID NO: 1460):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHYR corresponding to amino acids 1-36 of AAH16184 (SEQ ID NO:1460), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGMSQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWTLILM (SEQ ID NO: 272) in R38144_PEA_2_P36 (SEQ ID NO:1408).

Comparison report between R38144_PEA_2_P36 (SEQ ID NO:1408) and AAQ88943 (SEQ ID NO:1461):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHY corresponding to amino acids 1-35 of AAQ88943 (SEQ ID NO:1461), which also corresponds to amino acids 1-35 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence RFWGMSQNSKEWLKCSRTAWTLILM corresponding to amino acids 36-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence RFWGMSQNSKEWLKCSRTAWTLILM in R38144_PEA_2_P36 (SEQ ID NO:1408).

Comparison report between R38144_PEA_2_P36 (SEQ ID NO:1408) and CT31_HUMAN (SEQ ID NO:1459):

1. An isolated chimeric polypeptide encoding for R38144_PEA_2_P36 (SEQ ID NO:1408), comprising a first amino acid sequence being at least 90% homologous to MPFRLLIPLGLLCALLPQHHGAPGPDGSAPDPAHYR corresponding to amino acids 1-36 of CT31_HUMAN (SEQ ID NO:1459), which also corresponds to amino acids 1-36 of R38144_PEA_2_P36 (SEQ ID NO:1408), and a second amino acid sequence being at least 70%, optionally at least 80%, preferably at least 85%, more preferably at least 90% and most preferably at least 95% homologous to a polypeptide having the sequence FWGMSQNSKEWLKCSRTAWTLILM (SEQ ID NO: 272) corresponding to amino acids 37-60 of R38144_PEA_2_P36 (SEQ ID NO:1408), wherein said first amino acid sequence and second amino acid sequence are contiguous and in a sequential order.

2. An isolated polypeptide encoding for a tail of R38144_PEA_2_P36 (SEQ ID NO:1408), comprising a polypeptide being at least 70%, optionally at least about 80%, preferably at least about 85%, more preferably at least about 90% and most preferably at least about 95% homologous to the sequence FWGMSQNSKEWLKCSRTAWTLILM (SEQ ID NO: 272) in R38144_PEA_2_P36 (SEQ ID NO:1408).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R38144_PEA_2_P36 (SEQ ID NO:1408) also has the following non-silent SNPs (Single Nucleotide Polymorphisms) as listed in Table 1167, (given according to their position(s) on the amino acid sequence, with the alternative amino acid(s) listed; the last column indicates whether the SNP is known or not; the presence of known SNPs invariant protein R38144_PEA_2_P36(SEQ ID NO:1408) sequence provides support for the deduced sequence of this variant protein according to the present invention).

TABLE 1167

Amino acid mutations

| SNP position(s) on amino acid sequence | Alternative amino acid(s) | Previously known SNP? |
|---|---|---|
| 10 | G -> | No |
| 37 | F -> | No |

The glycosylation sites of variant protein R38144_PEA_2_P36 (SEQ ID NO:1408), as compared to the known protein Putative alpha-mannosidase C20orf31 precursor (SEQ ID NO:1459), are described in Table 1168 (given according to their position(s) on the amino acid sequence in the first column; the second column indicates whether the glycosylation site is present in the variant protein; and the last column indicates whether the position is different on the variant protein).

TABLE 1168

Glycosylation site(s)

| Position(s) on known amino acid sequence | Present in variant protein? |
|---|---|
| 450 | no |
| 289 | no |
| 112 | no |
| 90 | no |

Variant protein R38144_PEA_2_P36 (SEQ ID NO:1408) is encoded by the following transcript(s): R38144_PEA_2_T10 (SEQ ID NO:136), for which the sequence(s) is/are given at the end of the application. The coding portion of transcript R38144_PEA_2_T10 (SEQ ID NO:136) is shown in bold; this coding portion starts at position 91 and ends at position 270. The transcript also has the following SNPs as listed in Table 1169 (given according to their position on the nucleotide sequence, with the alternative nucleic acid listed; the last column indicates whether the SNP is known or not; the presence of known SNPs in variant protein R38144_PEA_2_P36 (SEQ ID NO:1408) sequence provides support for the deduced sequence of this variant protein according to the present invention).

TABLE 1169

Nucleic acid SNPs

| SNP position on nucleotide sequence | Alternative nucleic acid | Previously known SNP? |
|---|---|---|
| 120 | C -> | No |
| 199 | T -> | No |
| 372 | C -> | No |
| 372 | C -> G | No |
| 430 | C -> | No |
| 430 | C -> G | No |
| 547 | C -> | No |
| 547 | C -> G | No |
| 572 | C -> | No |
| 647 | C -> | No |
| 647 | C -> G | No |
| 698 | -> C | No |
| 698 | -> G | No |
| 733 | T -> G | No |
| 750 | -> C | No |
| 750 | -> T | No |
| 792 | A -> | No |
| 819 | G -> A | No |

TABLE 1169-continued

Nucleic acid SNPs

| SNP position on nucleotide sequence | Alternative nucleic acid | Previously known SNP? |
|---|---|---|
| 853 | G -> A | No |
| 907 | A -> G | No |
| 975 | T -> | No |
| 1067 | C -> T | Yes |
| 1216 | A -> G | No |
| 1249 | T -> C | No |
| 1305 | G -> A | Yes |
| 1384 | C -> T | No |
| 1390 | C -> | No |
| 1468 | G -> A | Yes |
| 1470 | A -> T | No |
| 1587 | A -> | No |
| 1587 | A -> C | No |
| 1605 | C -> T | Yes |
| 1623 | C -> | No |
| 1623 | C -> G | No |
| 1668 | T -> G | No |
| 1679 | A -> C | Yes |

As noted above, cluster R38144 features 24 segment(s), which were listed in Table 1147 above and for which the sequence(s) are given at the end of the application. These segment(s) are portions of nucleic acid sequence(s) which are described herein separately because they are of particular interest. A description of each segment according to the present invention is now provided.

Segment cluster R38144_PEA_2_node_21 (SEQ ID NO:937) according to the present invention is supported by 108 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1170 below describes the starting and ending position of this segment on each transcript.

TABLE 1170

Segment location on transcripts

| Transcript name | Segment starting position | Segment ending position |
|---|---|---|
| R38144_PEA_2_T6 (SEQ ID NO:135) | 626 | 792 |
| R38144_PEA_2_T10 (SEQ ID NO:136) | 475 | 641 |
| R38144_PEA_2_T13 (SEQ ID NO:137) | 626 | 792 |
| R38144_PEA_2_T15 (SEQ ID NO:138) | 626 | 792 |
| R38144_PEA_2_T19 (SEQ ID NO:139) | 626 | 792 |

Segment cluster R38144_PEA_2_node_26 (SEQ ID NO:938) according to the present invention is supported by 98 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13(SEQ ID NO:137), R38144_PEA_2_T15(SEQ ID NO:138) and R38144_PEA_2_T19 (SEQ ID NO:139). Table 1171 below describes the starting and ending position of this segment on each transcript.

TABLE 1171

Segment location on transcripts

| Transcript name | Segment starting position | Segment ending position |
|---|---|---|
| R38144_PEA_2_T6 (SEQ ID NO:135) | 793 | 934 |
| R38144_PEA_2_T10 (SEQ ID NO:136) | 642 | 783 |
| R38144_PEA_2_T13 (SEQ ID NO:137) | 793 | 934 |
| R38144_PEA_2_T15 (SEQ ID NO:138) | 793 | 934 |
| R38144_PEA_2_T19 (SEQ ID NO:139) | 793 | 934 |

Segment cluster R38144_PEA_2_node_29 (SEQ ID NO:939) according to the present invention is supported by 98 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13(SEQ ID NO:137), R38144_PEA_2_T19(SEQ ID NO:139) and R38144_PEA_2_T27 (SEQ ID NO:140). Table 1172 below describes the starting and ending position of this segment on each transcript.

TABLE 1172

Segment location on transcripts

| Transcript name | Segment starting position | Segment ending position |
|---|---|---|
| R38144_PEA_2_T6 (SEQ ID NO:135) | 935 | 1059 |
| R38144_PEA_2_T10 (SEQ ID NO:136) | 784 | 908 |
| R38144_PEA_2_T13 (SEQ ID NO:137) | 935 | 1059 |
| R38144_PEA_2_T19 (SEQ ID NO:139) | 935 | 1059 |
| R38144_PEA_2_T27 (SEQ ID NO:140) | 455 | 579 |

Segment cluster R38144_PEA_2_node_31 (SEQ ID NO:940) according to the present invention is supported by 95 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T15(SEQ ID NO:138), R38144_PEA_2_T19(SEQ ID NO:139) and R38144_PEA_2_T27 (SEQ ID NO:140). Table 1173 below describes the starting and ending position of this segment on each transcript.

TABLE 1173

Segment location on transcripts

| Transcript name | Segment starting position | Segment ending position |
|---|---|---|
| R38144_PEA_2_T6 (SEQ ID NO:135) | 1060 | 1204 |
| R38144_PEA_2_T10 (SEQ ID NO:136) | 909 | 1053 |
| R38144_PEA_2_T15 (SEQ ID NO:138) | 935 | 1079 |
| R38144_PEA_2_T19 (SEQ ID NO:139) | 1060 | 1204 |

TABLE 1173-continued

Segment location on transcripts

| Transcript name | Segment starting position | Segment ending position |
|---|---|---|
| R38144_PEA_2_T27 (SEQ ID NO:140) | 580 | 724 |

Segment cluster R38144_PEA_2_node_46 (SEQ ID NO:941) according to the present invention is supported by 147 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T27 (SEQ ID NO:140). Table 1174 below describes the starting and ending position of this segment on each transcript.

TABLE 1174

Segment location on transcripts

| Transcript name | Segment starting position | Segment ending position |
|---|---|---|
| R38144_PEA_2_T6 (SEQ ID NO:135) | 1373 | 1544 |
| R38144_PEA_2_T10 (SEQ ID NO:136) | 1197 | 1368 |
| R38144_PEA_2_T13 (SEQ ID NO:137) | 1203 | 1374 |
| R38144_PEA_2_T15 (SEQ ID NO:138) | 1223 | 1394 |
| R38144_PEA_2_T27 (SEQ ID NO:140) | 868 | 1039 |

Segment cluster R38144_PEA_2_node_47 (SEQ ID NO:942) according to the present invention is supported by 147 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T27 (SEQ ID NO:140). Table 1175 below describes the starting and ending position of this segment on each transcript.

TABLE 1175

Segment location on transcripts

| Transcript name | Segment starting position | Segment ending position |
|---|---|---|
| R38144_PEA_2_T6 (SEQ ID NO:135) | 1545 | 1919 |
| R38144_PEA_2_T10 (SEQ ID NO:136) | 1369 | 1743 |
| R38144_PEA_2_T13 (SEQ ID NO:137) | 1375 | 1749 |
| R38144_PEA_2_T15 (SEQ ID NO:138) | 1395 | 1769 |
| R38144_PEA_2_T27 (SEQ ID NO:140) | 1040 | 1414 |

Segment cluster R38144_PEA_2_node_49 (SEQ ID NO:943) according to the present invention is supported by 1 libraries. The number of libraries was determined as previously described. This segment can be found in the following transcript(s): R38144_PEA_2_T19 (SEQ ID NO:139). Table 1176 below describes the starting and ending position of this segment on each transcript.

TABLE 1176

Segment location on transcripts

| Transcript name | Segment starting position | Segment ending position |
|---|---|---|
| R38144_PEA_2_T19 (SEQ ID NO:139) | 1327 | 1448 |

According to an optional embodiment of the present invention, short segments related to the above cluster are also provided. These segments are up to about 120 bp in length, and so are included in a separate description.

Segment cluster R38144_PEA_2_node_0 (SEQ ID NO:944) according to the present invention is supported by 101 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1177 below describes the starting and ending position of this segment on each transcript.

TABLE 1177

Segment location on transcripts

| Transcript name | Segment starting position | Segment ending position |
|---|---|---|
| R38144_PEA_2_T6 (SEQ ID NO:135) | 1 | 105 |
| R38144_PEA_2_T10 (SEQ ID NO:136) | 1 | 105 |
| R38144_PEA_2_T13 (SEQ ID NO:137) | 1 | 105 |
| R38144_PEA_2_T15 (SEQ ID NO:138) | 1 | 105 |
| R38144_PEA_2_T19 (SEQ ID NO:139) | 1 | 105 |
| R38144_PEA_2_T27 (SEQ ID NO:140) | 1 | 105 |

Segment cluster R38144_PEA_2_node_1 (SEQ ID NO:945) according to the present invention is supported by 105 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1178 below describes the starting and ending position of this segment on each transcript.

TABLE 1178

Segment location on transcripts

| Transcript name | Segment starting position | Segment ending position |
|---|---|---|
| R38144_PEA_2_T6 (SEQ ID NO:135) | 106 | 197 |
| R38144_PEA_2_T10 (SEQ ID NO:136) | 106 | 197 |

TABLE 1178-continued

Segment location on transcripts

| Transcript name | Segment starting position | Segment ending position |
|---|---|---|
| R38144_PEA_2_T13 (SEQ ID NO:137) | 106 | 197 |
| R38144_PEA_2_T15 (SEQ ID NO:138) | 106 | 197 |
| R38144_PEA_2_T19 (SEQ ID NO:139) | 106 | 197 |
| R38144_PEA_2_T27 (SEQ ID NO:140) | 106 | 197 |

Segment cluster R38144_PEA_2_node_4 (SEQ ID NO:946) according to the present invention is supported by 107 libraries. The number of libraries was determined as previously described. This segment can be found in the following transcript(s): R38144_PEA_2_T6 (SEQ ID NO:135), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1179 below describes the starting and ending position of this segment on each transcript.

TABLE 1179

Segment location on transcripts

| Transcript name | Segment starting position | Segment ending position |
|---|---|---|
| R38144_PEA_2_T6 (SEQ ID NO:135) | 198 | 299 |
| R38144_PEA_2_T13 (SEQ ID NO:137) | 198 | 299 |
| R38144_PEA_2_T15 (SEQ ID NO:138) | 198 | 299 |
| R38144_PEA_2_T19 (SEQ ID NO:139) | 198 | 299 |
| R38144_PEA_2_T27 (SEQ ID NO:140) | 198 | 299 |

Segment cluster R38144_PEA_2_node_5 (SEQ ID NO:947) according to the present invention can be found in the following transcript(s): R38144_PEA_2_T6 (SEQ ID NO:135), R38144_PEA_2_T13 (SEQ ID NO:137), R38144_PEA_2_T15(SEQ ID NO:138), R38144_PEA_2_T19(SEQ ID NO:139) and R38144_PEA_2_T27 (SEQ ID NO:140). Table 1180 below describes the starting and ending position of this segment on each transcript.

TABLE 1180

Segment location on transcripts

| Transcript name | Segment starting position | Segment ending position |
|---|---|---|
| R38144_PEA_2_T6 (SEQ ID NO:135) | 300 | 308 |
| R38144_PEA_2_T13 (SEQ ID NO:137) | 300 | 308 |
| R38144_PEA_2_T15 (SEQ ID NO:138) | 300 | 308 |
| R38144_PEA_2_T19 (SEQ ID NO:139) | 300 | 308 |
| R38144_PEA_2_T27 (SEQ ID NO:140) | 300 | 308 |

Segment cluster R38144_PEA_2_node_7 (SEQ ID NO:948) according to the present invention is supported by 92 libraries. The number of libraries was determined as previously described. This segment can be found in the following transcript(s): R38144_PEA_2_T6 (SEQ ID NO:135), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1181 below describes the starting and ending position of this segment on each transcript.

TABLE 1181

Segment location on transcripts

| Transcript name | Segment starting position | Segment ending position |
|---|---|---|
| R38144_PEA_2_T6 (SEQ ID NO:135) | 309 | 348 |
| R38144_PEA_2_T13 (SEQ ID NO:137) | 309 | 348 |
| R38144_PEA_2_T15 (SEQ ID NO:138) | 309 | 348 |
| R38144_PEA_2_T19 (SEQ ID NO:139) | 309 | 348 |
| R38144_PEA_2_T27 (SEQ ID NO:140) | 309 | 348 |

Segment cluster R38144_PEA_2_node_11 (SEQ ID NO:949) according to the present invention is supported by 106 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1182 below describes the starting and ending position of this segment on each transcript.

TABLE 1182

Segment location on transcripts

| Transcript name | Segment starting position | Segment ending position |
|---|---|---|
| R38144_PEA_2_T6 (SEQ ID NO:135) | 349 | 454 |
| R38144_PEA_2_T10 (SEQ ID NO:136) | 198 | 303 |
| R38144_PEA_2_T13 (SEQ ID NO:137) | 349 | 454 |
| R38144_PEA_2_T15 (SEQ ID NO:138) | 349 | 454 |
| R38144_PEA_2_T19 (SEQ ID NO:139) | 349 | 454 |
| R38144_PEA_2_T27 (SEQ ID NO:140) | 349 | 454 |

Segment cluster R38144_PEA_2_node_14 (SEQ ID NO:950) according to the present invention can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1183 below describes the starting and ending position of this segment on each transcript.

TABLE 1183

Segment location on transcripts

| Transcript name | Segment starting position | Segment ending position |
|---|---|---|
| R38144_PEA_2_T6 (SEQ ID NO:135) | 455 | 460 |
| R38144_PEA_2_T10 (SEQ ID NO:136) | 304 | 309 |
| R38144_PEA_2_T13 (SEQ ID NO:137) | 455 | 460 |
| R38144_PEA_2_T15 (SEQ ID NO:138) | 455 | 460 |
| R38144_PEA_2_T19 (SEQ ID NO:139) | 455 | 460 |

Segment cluster R38144_PEA_2_node_15 (SEQ ID NO:951) according to the present invention is supported by 105 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1184 below describes the starting and ending position of this segment on each transcript.

TABLE 1184

Segment location on transcripts

| Transcript name | Segment starting position | Segment ending position |
|---|---|---|
| R38144_PEA_2_T6 (SEQ ID NO:135) | 461 | 487 |
| R38144_PEA_2_T10 (SEQ ID NO:136) | 310 | 336 |
| R38144_PEA_2_T13 (SEQ ID NO:137) | 461 | 487 |
| R38144_PEA_2_T15 (SEQ ID NO:138) | 461 | 487 |
| R38144_PEA_2_T19 (SEQ ID NO:139) | 461 | 487 |

Segment cluster R38144_PEA_2_node_16 (SEQ ID NO:952) according to the present invention is supported by 106 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1185 below describes the starting and ending position of this segment on each transcript.

TABLE 1185

Segment location on transcripts

| Transcript name | Segment starting position | Segment ending position |
|---|---|---|
| R38144_PEA_2_T6 (SEQ ID NO:135) | 488 | 580 |
| R38144_PEA_2_T10 (SEQ ID NO:136) | 337 | 429 |
| R38144_PEA_2_T13 (SEQ ID NO:137) | 488 | 580 |
| R38144_PEA_2_T15 (SEQ ID NO:138) | 488 | 580 |
| R38144_PEA_2_T19 (SEQ ID NO:139) | 488 | 580 |

Segment cluster R38144_PEA_2_node_19 (SEQ ID NO:953) according to the present invention is supported by 93 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1186 below describes the starting and ending position of this segment on each transcript.

TABLE 1186

Segment location on transcripts

| Transcript name | Segment starting position | Segment ending position |
|---|---|---|
| R38144_PEA_2_T6 (SEQ ID NO:135) | 581 | 615 |
| R38144_PEA_2_T10 (SEQ ID NO:136) | 430 | 464 |
| R38144_PEA_2_T13 (SEQ ID NO:137) | 581 | 615 |
| R38144_PEA_2_T15 (SEQ ID NO:138) | 581 | 615 |
| R38144_PEA_2_T19 (SEQ ID NO:139) | 581 | 615 |

Segment cluster R38144_PEA_2_node_20 (SEQ ID NO:954) according to the present invention can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138) and R38144_PEA_2_T19 (SEQ ID NO:139). Table 1187 below describes the starting and ending position of this segment on each transcript.

TABLE 1187

Segment location on transcripts

| Transcript name | Segment starting position | Segment ending position |
|---|---|---|
| R38144_PEA_2_T6 (SEQ ID NO:135) | 616 | 625 |
| R38144_PEA_2_T10 (SEQ ID NO:136) | 465 | 474 |
| R38144_PEA_2_T13 (SEQ ID NO:137) | 616 | 625 |
| R38144_PEA_2_T15 (SEQ ID NO:138) | 616 | 625 |
| R38144_PEA_2_T19 (SEQ ID NO:139) | 616 | 625 |

Segment cluster R38144_PEA_2_node_36 (SEQ ID NO:955) according to the present invention is supported by 95 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1188 below describes the starting and ending position of this segment on each transcript.

TABLE 1188

Segment location on transcripts

| Transcript name | Segment starting position | Segment ending position |
|---|---|---|
| R38144_PEA_2_T6 (SEQ ID NO:135) | 1205 | 1293 |
| R38144_PEA_2_T10 (SEQ ID NO:136) | 1054 | 1142 |
| R38144_PEA_2_T13 (SEQ ID NO:137) | 1060 | 1148 |
| R38144_PEA_2_T15 (SEQ ID NO:138) | 1080 | 1168 |
| R38144_PEA_2_T19 (SEQ ID NO:139) | 1205 | 1293 |
| R38144_PEA_2_T27 (SEQ ID NO:140) | 725 | 813 |

Segment cluster R38144_PEA_2_node_37 (SEQ ID NO:956) according to the present invention is supported by 97 libraries. The number of libraries was determined as previously described. This segment can be found in the following transcript(s): R38144_PEA_2_T6 (SEQ ID NO:135), R38144_PEA_2_T10 (SEQ ID NO:136), R38144_PEA_

2_T13 (SEQ ID NO:137), R38144_PEA_2_T15 (SEQ ID NO:138), R38144_PEA_2_T19 (SEQ ID NO:139) and R38144_PEA_2_T27 (SEQ ID NO:140). Table 1213 below describes the starting and ending position of this segment on each transcript.

TABLE 1213

Segment location on transcripts

| Transcript name | Segment starting position | Segment ending position |
|---|---|---|
| R38144_PEA_2_T6 (SEQ ID NO:135) | 1294 | 1326 |
| R38144_PEA_2_T10 (SEQ ID NO:136) | 1143 | 1175 |
| R38144_PEA_2_T13 (SEQ ID NO:137) | 1149 | 1181 |
| R38144_PEA_2_T15 (SEQ ID NO:138) | 1169 | 1201 |
| R38144_PEA_2_T19 (SEQ ID NO:139) | 1294 | 1326 |
| R38144_PEA_2_T27 (SEQ ID NO:140) | 814 | 846 |

Segment cluster R38144_PEA_2_node_43 (SEQ ID NO:957) according to the present invention can be found in the following transcript(s): R38144_PEA_2_T6 (SEQ ID NO:135). Table 1189 below describes the starting and ending position of this segment on each transcript.

TABLE 1189

Segment location on transcripts

| Transcript name | Segment starting position | Segment ending position |
|---|---|---|
| R38144_PEA_2_T6 (SEQ ID NO:135) | 1327 | 1346 |

Segment cluster R38144_PEA_2_node_44 (SEQ ID NO:958) according to the present invention can be found in the following transcript(s): R38144_PEA_2_T6 (SEQ ID NO:135). Table 1190 below describes the starting and ending position of this segment on each transcript.

TABLE 1190

Segment location on transcripts

| Transcript name | Segment starting position | Segment ending position |
|---|---|---|
| R38144_PEA_2_T6 (SEQ ID NO:135) | 1347 | 1351 |

Segment cluster R38144_PEA_2_node_45 (SEQ ID NO:959) according to the present invention can be found in the following transcript(s): R38144_PEA_2_T6 (SEQ ID NO:135), R38144_PEA_2_T10 (SEQ ID NO:136), R38144_PEA_2_T13(SEQ ID NO:137), R38144_PEA_2_T15(SEQ ID NO:138) and R38144_PEA_2_T27 (SEQ ID NO:140). Table 1191 below describes the starting and ending position of this segment on each transcript.

TABLE 1191

Segment location on transcripts

| Transcript name | Segment starting position | Segment ending position |
|---|---|---|
| R38144_PEA_2_T6 (SEQ ID NO:135) | 1352 | 1372 |
| R38144_PEA_2_T10 (SEQ ID NO:136) | 1176 | 1196 |
| R38144_PEA_2_T13 (SEQ ID NO:137) | 1182 | 1202 |
| R38144_PEA_2_T15 (SEQ ID NO:138) | 1202 | 1222 |
| R38144_PEA_2_T27 (SEQ ID NO:140) | 847 | 867 |

Segment cluster R38144_PEA_2_node_51 (SEQ ID NO:960) according to the present invention is supported by 1 libraries. The number of libraries was determined as previously described. This segment can be found in the following transcript(s): R38144_PEA_2_T19 (SEQ ID NO:139). Table 1192 below describes the starting and ending position of this segment on each transcript.

TABLE 1192

Segment location on transcripts

| Transcript name | Segment starting position | Segment ending position |
|---|---|---|
| R38144_PEA_2_T19 (SEQ ID NO:139) | 1449 | 1522 |

Variant protein alignment to the previously known protein:

Sequence name: CT31_HUMAN (SEQ ID NO:1459)

Sequence documentation:

Alignment of: R38144_PEA_2_P6 (SEQ ID NO:1403) x CT31_HUMAN (SEQ ID NO:1459)

Alignment segment 1/1:

| Quality: | 4031.00 | Escore: | 0 |
|---|---|---|---|
| Matching length: | 413 | Total length: | 413 |
| Matching Percent Similarity: | 100.00 | Matching Percent Identity: | 99.76 |
| Total Percent Similarity: | 100.00 | Total Percent Identity: | 99.76 |
| Gaps: | 0 | | |

Alignment:

```
  1 MPFRLLIPLGLLCALLPQHHGAPGPDGSAPDPAHYRERVKAMFYHAYDSY  50
    ||||||||||||||||||||||||||||||||||||||||||||||||||
  1 MPFRLLIPLGLLCALLPQHHGAPGPDGSAPDPAHYRERVKAMFYHAYDSY  50

51 LENAFPFDELRPLTCDGHDTWGSFSLTLIDALDTLLILGNVSEFQRVVEV 100
    ||||||||||||||||||||||||||||||||||||||||||||||||||
 51 LENAFPFDELRPLTCDGHDTWGSFSLTLIDALDTLLILGNVSEFQRVVEV 100
```

```
101   LQDSVDFDIDVNASVFETNIRVVGGLLSAHLLSKKAGVEVEAGWPCSGPL   150
      ||||||||||||||||||||||||||||||||||||||||||||||||||
101   LQDSVDFDIDVNASVFETNIRVVGGLLSAHLLSKKAGVEVEAGWPCSGPL   150

151   LRMAEEAARKLLPAFQTPTGMPYGTVNLLHGVNPGETPVTCTAGIGTFIV   200
      |||||||||||||||||||||||||||||||||||||||||||||||||
151   LRMAEEAARKLLPAFQTPTGMPYGTVNLLHGVNPGETPVTCTAGIGTFIV   200

201   EFATLSSLTGDPVFEDVARVALMRLWESRSDIGLVGNHIDVLTGKWVAQD   250
      |||||||||||||||||||||||||||||||||||||||||||||||||
201   EFATLSSLTGDPVFEDVARVALMRLWESRSDIGLVGNHIDVLTGKWVAQD   250

251   AGIGAGVDSYFEYLVKGAILLQDKKLMAMFLEYNKAIRNYTRFDDWYLWV   300
      |||||||||||||||||||||||||||||||||||||||||||||||||
251   AGIGAGVDSYFEYLVKGAILLQDKKLMAMFLEYNKAIRNYTRFDDWYLWV   300

301   QMYKGTVSMPVFQSLEAYWPGLQSLIGDIDNAMRTFLNYYTVWKQFGGLP   350
      |||||||||||||||||||||||||||||||||||||||||||||||||
301   QMYKGTVSMPVFQSLEAYWPGLQSLIGDIDNAMRTFLNYYTVWKQFGGLP   350

351   EFYNIPQGYTVEKREGYPLRPELIESAMYLRATGDPTLLELGRDAVESI    400
      ||||||||||||||||||||||||||||||||||||||||||||||||
351   EFYNIPQGYTVEKREGYPLRPELIESAMYLRATGDPTLLELGRDAVESI    400

401   EKISKVECGFATL                                        413
      ||||||||||||:
401   EKISKVECGFATI                                        413
```

Sequence name: CT31_HUMAN (SEQ ID NO:1459)

Sequence documentation:

Alignment of: R38144_PEA__2_P13 (SEQ ID NO:1404) x CT31_HUMAN (SEQ ID NO:1459) . . .

Alignment segment 1/1:

| Quality: | 3167.00 | Escore: | 0 |
|---|---|---|---|
| Matching length: | 326 | Total length: | 326 |
| Matching Percent Similarity: | 100.00 | Matching Percent Identity: | 99.39 |
| Total Percent Similarity: | 100.00 | Total Percent Identity: | 99.39 |
| Gaps: | 0 | | |

Alignment

```
  1   MPFRLLIPLGLLCALLPQHHGAPGPDGSAPDPHAYRERVKAMFYHAYDSY   50
      |||||||||||||||||||||||||||||||||||||||||||||||||
  1   MPFRLLIPLGLLCALLPQHHGAPGPDGSAPDPHAYRERVKAMFYHAYDSY   50

51   LENAFPFDELRPLTCDGHDTWGSFSLTLIDALDTLLILGNVSEFQRVVEV   100
      |||||||||||||||||||||||||||||||||||||||||||||||||
 51   LENAFPFDELRPLTCDGHDTWGSFSLTLIDALDTLLILGNVSEFQRVVEV   100

101   LQDSVDFDIDVNASVFETNIRVVGGLLSAHLLSKKAGVEVEAGWPCSGPL   150
      |||||||||||||||||||||||||||||||||||||||||||||||||
101   LQDSVDFDIDVNASVFETNIRVVGGLLSAHLLSKKAGVEVEAGWPCSGPL   150

151   LRMAEEAARKLLPAFQTPTGMPYGTVNLLHGVNPGETPVTCTAGIGTFIV   200
      |||||||||||||||||||||||||||||||||||||||||||||||||
151   LRMAEEAARKLLPAFQTPTGMPYGTVNLLHGVNPGETPVTCTAGIGTFIV   200

201   EFATLSSLTGDPVFEDVARVALMRLWESRSDIGLVGNHIDVLTGKWVAQD   250
      |||||||||||||||||||||||||||||||||||||||||||||||||
201   EFATLSSLTGDPVFEDVARVALMRLWESRSDIGLVGNHIDVLTGKWVAQD   250

251   AGIGAGVDSYFEYLVKGAILLQDKKLMAMFLEYNKAIRNYTRFDDWYLWV   300
      |||||||||||||||||||||||||||||||||||||||||||||||||
251   AGIGAGVDSYFEYLVKGAILLQDKKLMAMFLEYNKAIRNYTRFDDWYLWV   300

301   QMYKGTVSMPVFQSLEAYWPGLQNLL                           326
      ||||||||||||||||||||||::|:
301   QMYKGTVSMPVFQSLEAYWPGLQSLI                           326
```

Sequence name: CT31_HUMAN (SEQ ID NO:1459)

Alignment:

Sequence documentation:

Alignment of: R38144_PEA_2_P15 (SEQ ID NO:1405) x CT31_HUMAN (SEQ ID NO:1459) . . .

Alignment segment 1/1:

| Quality: | 2725.00 | Escore: | 0 |
|---|---|---|---|
| Matching length: | 282 | Total length: | 282 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
  1  MPFRLLIPLGLLCALLPQHHGAPGPDGSAPDPAHYRERVKAMFYHAYDSY   50
     ||||||||||||||||||||||||||||||||||||||||||||||||||
  1  MPFRLLIPLGLLCALLPQHHGAPGPDGSAPDPAHYRERVKAMFYHAYDSY   50

51  LENAFPFDELRPLTCDGHDTWGSFSLTLIDALDTLLILGNVSEFQRVVEV  100
     ||||||||||||||||||||||||||||||||||||||||||||||||||
 51  LENAFPFDELRPLTCDGHDTWGSFSLTLIDALDTLLILGNVSEFQRVVEV  100

101  LQDSVDFDIDVNASVFETNIRVVGGLLSAHLLSKKAGVEVEAGWPCSGPL  150
     ||||||||||||||||||||||||||||||||||||||||||||||||||
101  LQDSVDFDIDVNASVFETNIRVVGGLLSAHLLSKKAGVEVEAGWPCSGPL  150

151  LRMAEEAARKLLPAFQTPTGMPYGTVNLLHGVNPGETPVTCTAGIGTFIV  200
     ||||||||||||||||||||||||||||||||||||||||||||||||||
151  LRMAEEAARKLLPAFQTPTGMPYGTVNLLHGVNPGETPVTCTAGIGTFIV  200

201  EFATLSSLTGDPVFEDVARVALMRLWESRSDIGLVGNHIDVLTGKWVAQD  250
     ||||||||||||||||||||||||||||||||||||||||||||||||||
201  EFATLSSLTGDPVFEDVARVALMRLWESRSDIGLVGNHIDVLTGKWVAQD  250

251  AGIGAGVDSYFEYLVKGAILLQDKKLMAMFLE                   282
     ||||||||||||||||||||||||||||||||
251  AGIGAGVDSYFEYLVKGAILLQDKKLMAMFLE                   282
```

Sequence name: CT31_HUMAN (SEQ ID NO:1459)

Sequence documentation:

Alignment of: R38144_PEA_2_P19 (SEQ ID NO:1406) x CT31_HUMAN (SEQ ID NO:1459) . . .

Alignment segment 1/1:

| Quality: | 4029.00 | Escore: | 0 |
|---|---|---|---|
| Matching length: | 412 | Total length: | 412 |
| Matching Percent Similarity: | 100.00 | Matching Percent Identity: | 100.00 |
| Total Percent Similarity: | 100.00 | Total Percent Identity: | 100.00 |
| Gaps: | 0 | | |

```
  1  MPFRLLIPLGLLCALLPQHHGAPGPDGSAPDPAHYRERVKAMFYHAYDSY     50
     ||||||||||||||||||||||||||||||||||||||||||||||||||
  1  MPFRLLIPLGLLCALLPQHHGAPGPDGSAPDPAHYRERVKAMFYHAYDSY     50

51  LENAFPFDELRPLTCDGHDTWGSFSLTLIDALDTLLILGNVSEFQRVVEV    100
     ||||||||||||||||||||||||||||||||||||||||||||||||||
 51  LENAFPFDELRPLTCDGHDTWGSFSLTLIDALDTLLILGNVSEFQRVVEV    100

101  LQDSVDFDIDVNASVFETNIRVVGGLLSAHLLSKKAGVEVEAGWPCSGPL    150
     ||||||||||||||||||||||||||||||||||||||||||||||||||
101  LQDSVDFDIDVNASVFETNIRVVGGLLSAHLLSKKAGVEVEAGWPCSGPL    150

151  LRMAEEAARKLLPAFQTPTGMPYGTVNLLHGVNPGETPVTCTAGIGTFIV    200
     ||||||||||||||||||||||||||||||||||||||||||||||||||
151  LRMAEEAARKLLPAFQTPTGMPYGTVNLLHGVNPGETPVTCTAGIGTFIV    200

201  EFATLSSLTGDPVFEDVARVALMRLWESRSDIGLVGNHIDVLTGKWVAQD    250
     ||||||||||||||||||||||||||||||||||||||||||||||||||
201  EFATLSSLTGDPVFEDVARVALMRLWESRSDIGLVGNHIDVLTGKWVAQD    250

251  AGIGAGVDSYFEYLVKGAILLQDKKLMAMFLEYNKAIRNYTRFDDWYLWV    300
     ||||||||||||||||||||||||||||||||||||||||||||||||||
251  AGIGAGVDSYFEYLVKGAILLQDKKLMAMFLEYNKAIRNYTRFDDWYLWV    300

301  QMYKGTVSMPVFQSLEAYWPGLQSLIGDIDNAMRTFLNYYTVWKQFGGLP    350
     ||||||||||||||||||||||||||||||||||||||||||||||||||
301  QMYKGTVSMPVFQSLEAYWPGLQSLIGDIDNAMRTFLNYYTVWKQFGGLP    350

351  EFYNIPQGYTVEKREGYPLRPELIESAMYLYRATGDPTLLELGRDAVESI    400
     ||||||||||||||||||||||||||||||||||||||||||||||||||
351  EFYNIPQGYTVEKREGYPLRPELIESAMYLYRATGDPTLLELGRDAVESI    400

401  EKISKVECGFAT                                         412
     ||||||||||||
401  EKISKVECGFAT                                         412
```

Sequence name: CT31_HUMAN (SEQ ID NO:1459)

Sequence documentation:

Alignment of: R38144_PEA_2_P24 (SEQ ID NO:1407) x CT31_HUMAN (SEQ ID NO:1459) . . .

Alignment segment 1/1:

| | | | |
|---|---|---|---|
| Quality: | 4063.00 | Escore: | 0 |
| Matching length: | 418 | Total length: | 578 |
| Matching Percent Similarity: | 100.00 | Matching Percent Identity: | 100.00 |
| Total Percent Similarity: | 72.32 | Total Percent Identity: | 72.32 |
| Gaps: | 1 | | |

Alignment:

```
  1  MPFRLLIPLGLLCALLPQHHGAPGPDGSAPDPAHYRERVKAMFYHAYDSY     50
     ||||||||||||||||||||||||||||||||||||||||||||||||||
  1  MPFRLLIPLGLLCALLPQHHGAPGPDGSAPDPAHYRERVKAMFYHAYDSY     50

51  LENAFPFDELRPLTCDGHDTWGSFSLTLIDALDTLLILGNVSEFQRVVEV    100
     ||||||||||||||||||||||||||||||||||||||||||||||||||
 51  LENAFPFDELRPLTCDGHDTWGSFSLTLIDALDTLLILGNVSEFQRVVEV    100

101  LQDSVDFDIDVNASVFETNIR.............................    121
     |||||||||||||||||||||
101  LQDSVDFDIDVNASVFETNIRVVGGLLSAHLLSKKAGVEVEAGWPCSGPL    150

121  ..................................................    121

151  LRMAEEAARKLLPAFQTPTGMPYGTVNLLHGVNPGETPVTCTAGIGTFIV    200

121  ..................................................    121

201  EFATLSSLTGDPVFEDVARVALMRLWESRSDIGLVGNHIDVLTGKWVAQD    250
```

-continued

```
122 ............................EYNKAIRNYTRFDDWYKWV 140
    ||||||||||||||||||
251 AGIGAGVDSYFEYLVKGAILLQDKKLMAMFLEYNKAIRNYTRFDDWYKWV 300

141 QMYKGTVSMPVFQSLEAYWPGLQSLIGDIDNAMRTFLNYYTVWKQFGGLP 190
    |||||||||||||||||||||||||||||||||||||||||||||||||
301 QMYKGTVSMPVFQSLEAYWPGLQSLIGDIDNAMRTFLNYYTVWKQFGGLP 350

191 EFYNIPQGYTVEKREGYPLRPELIESAMYLRATGDPTLLELGRDAVESI 240
    ||||||||||||||||||||||||||||||||||||||||||||||||
351 EFYNIPQGYTVEKREGYPLRPELIESAMYLRATGDPTLLELGRDAVESI 400

241 EKISKVECGFATIKDLRDHKLDNRMESFFLAETVKYLYLLFDPTNFIHNN 290
    |||||||||||||||||||||||||||||||||||||||||||||||||
401 EKISKVECGFATIKDLRDHKLDNRMESFFLAETVKYLYLLFDPTNFIHNN 450

291 GSTFDAVITPYGECILGAGGYIFNTEAHPIDPAALHCCQRLKEEQWEVED 340
    |||||||||||||||||||||||||||||||||||||||||||||||||
451 GSTFDAVITPYGECILGAGGYIFNTEAHPIDPAALHCCQRLKEEQWEVED 500

341 LMREFYSLKRSRSKFQKNTVSSGPWEPPARPGTLFSPENHDQARERKPAK 390
    |||||||||||||||||||||||||||||||||||||||||||||||||
501 LMREFYSLKRSRSKFQKNTVSSGPWEPPARPGTLFSPENHDQARERKPAK 550

391 QKVPLLSCPSQPFTSKLALLGQVFLDSS                      718
    ||||||||||||||||||||||||||||
551 LMREFYSLKRSRSKFQKNTVSSGPWEPP                      578
```

Sequence name: AAH16184 (SEQ ID NO:1460)

Sequence documentation:

Alignment of: R38144_PEA_2_P36 (SEQ ID NO:1408) x AAH16184 (SEQ ID NO:1460)

Alignment segment 1/1:

| | | | |
|---|---|---|---|
| Quality: | 364.00 | Escore: | 0 |
| Matching length: | 36 | Total length: | 36 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MPFRLLIPLGLLCALLPQHHGAPGPDGSAPDPAHYR  36
   ||||||||||||||||||||||||||||||||||||
1  MPFRLLIPLGLLCALLPQHHGAPGPDGSAPDPAHYR  36
```

Sequence name: AAQ88943 (SEQ ID NO:1461)

Sequence documentation:

Alignment of: R38144_PEA_2_P36 (SEQ ID NO:1408) x AAQ88943 (SEQ ID NO:1461)

Alignment segment 1/1:

| | | | |
|---|---|---|---|
| Quality: | 362.00 | Escore: | 0 |
| Matching length: | 37 | Total length: | 37 |
| Matching Percent Similarity: | 97.30 | Matching Percent Identity: | 97.30 |
| Total Percent Similarity: | 97.30 | Total Percent Identity: | 97.30 |
| Gaps: | 0 | | |

Alignment:

```
1  MPFRLLIPLGLLCALLPQHHGAPGPDGSAPDPAHYRF  37
   ||||||||||||||||||||||||||||||||||||  |
1  MPFRLLIPLGLLCALLPQHHGAPGPDGSAPDPAHYSF  37
```

Sequence name: CT31_HUMAN (SEQ ID NO:1459)

Sequence documentation:

Alignment of: R38144_PEA_2_P36 (SEQ ID NO:1408) x CT31_HUMAN (SEQ ID NO:1459) . . .

Alignment segment 1/1:

| | | | |
|---|---|---|---|
| Quality: | 364.00 | Escore: | 0 |
| Matching length: | 36 | Total length: | 36 |
| Matching Percent Similarity: | 100.00 | Matching Percent Identity: | 100.00 |
| Total Percent Similarity: | 100.00 | Total Percent Identity: | 100.00 |
| Gaps: | 0 | | |

Alignment:

```
1  MPFRLLIPLGLLCALLPQHHGAPGPDGSAPDPAHYR  36
   ||||||||||||||||||||||||||||||||||||
1  MPFRLLIPLGLLCALLPQHHGAPGPDGSAPDPAHYR  36
```

Description for Cluster HUMOSTRO

Cluster HUMOSTRO features 3 transcript(s) and 30 segment(s) of interest, the names for which are given in Tables 1193 and 1194, respectively, the sequences themselves are given at the end of the application. The selected protein variants are given in table 1195.

TABLE 1193

Transcripts of interest

| Transcript Name | Sequence ID No. |
|---|---|
| HUMOSTRO_PEA_1_PEA_1_T14 | 141 |
| HUMOSTRO_PEA_1_PEA_1_T16 | 142 |
| HUMOSTRO_PEA_1_PEA_1_T30 | 143 |

TABLE 1194

Segments of interest

| Segment Name | Sequence ID No. |
|---|---|
| HUMOSTRO_PEA_1_PEA_1_node_0 | 961 |
| HUMOSTRO_PEA_1_PEA_1_node_10 | 962 |
| HUMOSTRO_PEA_1_PEA_1_node_16 | 963 |
| HUMOSTRO_PEA_1_PEA_1_node_23 | 964 |
| HUMOSTRO_PEA_1_PEA_1_node_31 | 965 |
| HUMOSTRO_PEA_1_PEA_1_node_43 | 966 |
| HUMOSTRO_PEA_1_PEA_1_node_3 | 967 |
| HUMOSTRO_PEA_1_PEA_1_node_5 | 968 |
| HUMOSTRO_PEA_1_PEA_1_node_7 | 969 |

TABLE 1194-continued

Segments of interest

| Segment Name | Sequence ID No. |
|---|---|
| HUMOSTRO_PEA_1_PEA_1_node_8 | 970 |
| HUMOSTRO_PEA_1_PEA_1_node_15 | 971 |
| HUMOSTRO_PEA_1_PEA_1_node_17 | 972 |
| HUMOSTRO_PEA_1_PEA_1_node_20 | 973 |
| HUMOSTRO_PEA_1_PEA_1_node_21 | 974 |
| HUMOSTRO_PEA_1_PEA_1_node_22 | 975 |
| HUMOSTRO_PEA_1_PEA_1_node_24 | 976 |
| HUMOSTRO_PEA_1_PEA_1_node_26 | 977 |
| HUMOSTRO_PEA_1_PEA_1_node_27 | 978 |
| HUMOSTRO_PEA_1_PEA_1_node_28 | 979 |

TABLE 1194-continued

Segments of interest

| Segment Name | Sequence ID No. |
|---|---|
| HUMOSTRO_PEA_1_PEA_1_node_29 | 980 |
| HUMOSTRO_PEA_1_PEA_1_node_30 | 981 |
| HUMOSTRO_PEA_1_PEA_1_node_32 | 982 |
| HUMOSTRO_PEA_1_PEA_1_node_34 | 983 |
| HUMOSTRO_PEA_1_PEA_1_node_36 | 984 |
| HUMOSTRO_PEA_1_PEA_1_node_37 | 985 |
| HUMOSTRO_PEA_1_PEA_1_node_38 | 986 |
| HUMOSTRO_PEA_1_PEA_1_node_39 | 987 |
| HUMOSTRO_PEA_1_PEA_1_node_40 | 988 |
| HUMOSTRO_PEA_1_PEA_1_node_41 | 989 |
| HUMOSTRO_PEA_1_PEA_1_node_42 | 990 |

TABLE 1195

Proteins of interest

| Protein Name | Sequence ID No. | Corresponding Transcript(s) |
|---|---|---|
| HUMOSTRO_PEA_1_PEA_1_P21 | 1627 | HUMOSTRO_PEA_1_PEA_1_T14 (SEQ ID NO:141) |
| HUMOSTRO_PEA_1_PEA_1_P25 | 1628 | HUMOSTRO_PEA_1_PEA_1_T16 (SEQ ID NO:142) |
| HUMOSTRO_PEA_1_PEA_1_P30 | 1629 | HUMOSTRO_PEA_1_PEA_1_T30 (SEQ ID NO:143) |

These sequences are variants of the known protein Osteopontin precursor (SwissProt accession identifier OSTP_HUMAN; known also according to the synonyms Bone sialoprotein 1; Urinary stone protein; Secreted phosphoprotein 1; SPP-1; Nephropontin; Uropontin), SEQ ID NO:1462, referred to herein as the previously known protein.

Protein Osteopontin precursor (SEQ ID NO:1462) is known or believed to have the following function(s): Binds tightly to hydroxyapatite. Appears to form an integral part of the mineralized matrix. Probably important to cell-matrix interaction. Acts as a cytokine involved in enhancing production of interferon-gamma and interleukin-12 and reducing production of interleukin-10 and is essential in the pathway that leads to type I immunity (By similarity). The sequence for protein Osteopontin precursor is given at the end of the application, as "Osteopontin precursor amino acid sequence". Known polymorphisms for this sequence are as shown in Table 1196.

TABLE 1196

Amino acid mutations for Known Protein

| SNP position(s) on amino acid sequence | Comment |
|---|---|
| 301 | R -> H (in dbSNP:4660)./FTIdVAR_014717. |
| 188 | D -> H |
| 237 | T -> A |
| 275-278 | SHEF -> GNSL |

Protein Osteopontin precursor (SEQ ID NO:1462) localization is believed to be Secreted.

The previously known protein also has the following indication(s) and/or potential therapeutic use(s): Regeneration, bone. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: Bone formation stimulant. A therapeutic role for a protein represented by the cluster has been predicted. The cluster was assigned this field because there was information in the drug database or the public databases (e.g., described herein above) that this protein, or part thereof, is used or can be used for a potential therapeutic indication: Musculoskeletal.

The following GO Annotation(s) apply to the previously known protein. The following annotation(s) were found: ossification; anti-apoptosis; inflammatory response; cell-matrix adhesion; cell-cell signaling, which are annotation(s) related to Biological Process; defense/immunity protein; cytokine; integrin ligand; protein binding; growth factor; apoptosis inhibitor, which are annotation(s) related to Molecular Function; and extracellular matrix, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster HUMOSTRO can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 46 refer to weighted expression of ESTs in each category, as "parts per million" (ratio of the expression of ESTs for a particular cluster to the expression of all ESTs in that category, according to parts per million).

Figure 46:
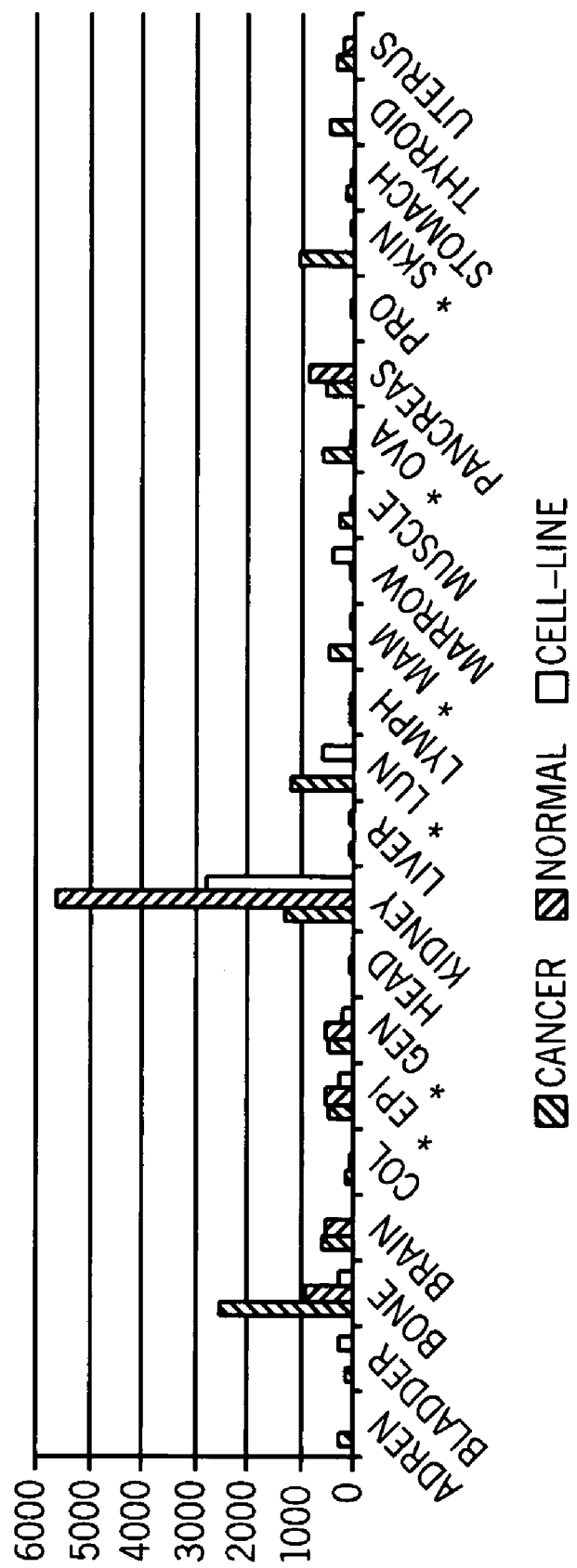
FIG. 46 is a histogram showing Cancer and cell-line vs. normal tissue expression for Cluster HUMOSTRO, demonstrating overexpression in epithelial malignant tumors, a mixture of malignant tumors from different tissues, lung malignant tumors, breast malignant tumors, ovarian carcinoma and skin malignancies.

Overall, the following results were obtained as shown with regard to the histograms in FIG. 46 and Table 1197. This cluster is overexpressed (at least at a minimum level) in the following pathological conditions: epithelial malignant tumors, a mixture of malignant tumors from different tissues, lung malignant tumors, breast malignant tumors, ovarian carcinoma and skin malignancies.

TABLE 1197

Normal tissue distribution

| Name of Tissue | Number |
|---|---|
| Adrenal | 4 |
| Bladder | 0 |
| Bone | 897 |
| Brain | 506 |
| Colon | 69 |
| Epithelial | 548 |
| General | 484 |
| head and neck | 50 |
| Kidney | 5618 |
| Liver | 4 |
| Lung | 10 |
| lymph nodes | 75 |
| Breast | 8 |
| bone marrow | 62 |
| Muscle | 37 |
| Ovary | 40 |
| Pancreas | 845 |
| Prostate | 48 |
| Skin | 13 |
| Stomach | 73 |
| Thyroid | 0 |
| Uterus | 168 |

TABLE 1198

P values and ratios for expression in cancerous tissue

| Name of Tissue | P1 | P2 | SP1 | R3 | SP2 | R4 |
|---|---|---|---|---|---|---|
| Adrenal | 1.5e-01 | 2.1e-01 | 2.0e-02 | 4.6 | 4.4e-02 | 3.6 |
| Bladder | 1.2e-01 | 9.2e-02 | 5.7e-02 | 4.1 | 2.1e-02 | 4.3 |
| Bone | 4.9e-01 | 7.4e-01 | 4.1e-06 | 0.6 | 5.4e-01 | 0.4 |
| Brain | 6.6e-01 | 7.0e-01 | 3.2e-01 | 0.6 | 1 | 0.4 |
| Colon | 2.7e-01 | 4.0e-01 | 3.1e-01 | 1.5 | 5.2e-01 | 1.1 |
| Epithelial | 2.0e-07 | 1.6e-03 | 9.8e-01 | 0.7 | 1 | 0.5 |
| General | 1.2e-06 | 1.2e-02 | 7.9e-01 | 0.8 | 1 | 0.6 |
| head and neck | 3.4e-01 | 5.0e-01 | 1 | 0.7 | 1 | 0.7 |
| Kidney | 6.8e-01 | 7.4e-01 | 1 | 0.2 | 1 | 0.1 |
| Liver | 3.3e-01 | 2.5e-01 | 1 | 1.8 | 2.3e-01 | 2.6 |
| Lung | 4.3e-04 | 4.6e-03 | 2.1e-30 | 15.0 | 2.8e-27 | 23.5 |
| lymph nodes | 6.7e-01 | 8.7e-01 | 8.1e-01 | 0.7 | 9.9e-01 | 0.3 |
| Breast | 2.3e-01 | 3.0e-01 | 1.9e-04 | 6.2 | 4.1e-03 | 4.3 |
| bone marrow | 7.5e-01 | 7.8e-01 | 1 | 0.3 | 2.0e-02 | 1.2 |
| Muscle | 4.0e-02 | 7.5e-02 | 1.1e-01 | 4.6 | 5.1e-01 | 1.5 |
| Ovary | 4.7e-02 | 8.4e-02 | 1.9e-05 | 5.4 | 8.3e-04 | 3.7 |
| Pancreas | 5.0e-02 | 3.3e-01 | 1 | 0.3 | 1 | 0.2 |
| Prostate | 8.5e-01 | 9.0e-01 | 8.9e-01 | 0.7 | 9.5e-01 | 0.6 |
| Skin | 1.6e-01 | 1.6e-01 | 1.2e-10 | 12.6 | 5.2e-04 | 4.1 |
| Stomach | 1.5e-01 | 6.3e-01 | 5.0e-01 | 1.2 | 9.4e-01 | 0.6 |
| Thyroid | 2.9e-01 | 2.9e-01 | 5.9e-02 | 2.0 | 5.9e-02 | 2.0 |
| Uterus | 6.1e-02 | 5.7e-01 | 1.1e-01 | 1.3 | 7.0e-01 | 0.7 |

As noted above, cluster HUMOSTRO features 3 transcript(s), which were listed in Table 1193 above. These transcript(s) encode for protein(s) which are variant(s) of protein Osteopontin precursor (SEQ ID NO:1462). A description of each variant protein according to the present invention is now provided.

Variant protein HUMOSTRO_PEA_1_PEA_1_P21 (SEQ ID NO:1627) according to the present invention has an amino acid sequence as given at the end of the application; it is encoded by transcript(s) HUMOSTRO_PEA_1_PEA_1_T14 (SEQ ID NO:141). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P21 (SEQ ID NO:1627) and OSTP_HUMAN (SEQ ID NO:1462):

1. An isolated chimeric polypeptide encoding for HUMOSTRO_PEA_1_PEA_1_P21 (SEQ ID NO:1627), comprising a first amino acid sequence being at least 90% homologous to MRIAVICFCLLGITCAIPVKQADSGS-SEEKQLYNKYPDAVATWLNPDPSQKQNLLAPQ corresponding to amino acids 1-58 of OSTP_HUMAN (SEQ ID NO:1462), which also corresponds to amino acids 1-58 of HUMOSTRO_PEA_1_PEA_1_P21 (SEQ ID NO:1627), and a second amino acid sequence being at least 70%, optionally at least 80%, preferably at least 85%, more preferably at least 90% and most preferably at least 95% homologous to a polypeptide having the sequence VFLNFS (SEQ ID NO: 261) corresponding to amino acids 59-64 of HUMOSTRO_PEA_1_PEA_1_P21 (SEQ ID NO:1627), wherein said first amino acid sequence and second amino acid sequence are contiguous and in a sequential order.

2. An isolated polypeptide encoding for a tail of HUMOSTRO_PEA_1_PEA_1_P21 (SEQ ID NO:1627), comprising a polypeptide being at least 70%, optionally at least about 80%, preferably at least about 85%, more preferably at least about 90% and most preferably at least about 95% homologous to the sequence VFLNFS (SEQ ID NO: 261) in HUMOSTRO_PEA_1_PEA_1_P21 (SEQ ID NO:1627).

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HUMOSTRO_PEA_1_PEA_1_P21 (SEQ ID NO:1627) also has the following non-silent SNPs (Single Nucleotide Polymorphisms) as listed in Table 1199, (given according to their position(s) on the amino acid sequence, with the alternative amino acid(s) listed; the last column indicates whether the SNP is known or not; the presence of known SNPs in variant protein HUMOSTRO_PEA_1_PEA_1_P21 (SEQ ID NO:1627) sequence provides support for the deduced sequence of this variant protein according to the present invention).

TABLE 1199

Amino acid mutations.

| SNP position(s) on amino acid sequence | Alternative amino acid(s) | Previously known SNP? |
|---|---|---|
| 7 | C -> W | No |
| 31 | Q -> R | No |
| 47 | D -> V | Yes |
| 49 | S -> P | No |

The glycosylation sites of variant protein HUMOSTRO_PEA_1_PEA_1_P21 (SEQ ID NO:1627), as compared to the known protein Osteopontin precursor (SEQ ID NO:1462), are described in Table 1200 (given according to their position(s) on the amino acid sequence in the first column; the second column indicates whether the glycosylation site is present in the variant protein; and the last column indicates whether the position is different on the variant protein).

TABLE 1200

Glycosylation site(s)

| Position(s) on known amino acid sequence | Present in variant protein? |
|---|---|
| 79 | no |
| 106 | no |

Variant protein HUMOSTRO_PEA_1_PEA_1_P21 (SEQ ID NO:1627) is encoded by the following transcript(s): HUMOSTRO_PEA_1_PEA_1_T14 (SEQ ID NO:141), for which the sequence(s) is/are given at the end of the application. The coding portion of transcript HUMOSTRO_PEA_1_PEA_1_T14 (SEQ ID NO:141) is shown in bold; this coding portion starts at position 199 and ends at position 390. The transcript also has the following SNPs as listed in Table 1201 (given according to their position on the nucleotide sequence, with the alternative nucleic acid listed; the last column indicates whether the SNP is known or not; the presence of known SNPs in variant protein HUMOSTRO_PEA_1_PEA_1_P21 (SEQ ID NO:1627) sequence provides support for the deduced sequence of this variant protein according to the present invention).

TABLE 1201

Nucleic acid SNPs

| SNP position on nucleotide sequence | Alternative nucleic acid | Previously known SNP? |
|---|---|---|
| 136 | A -> G | Yes |
| 154 | T -> | No |
| 159 | G -> T | Yes |
| 219 | C -> G | No |
| 274 | -> G | No |
| 290 | A -> G | No |
| 338 | A -> T | Yes |
| 343 | T -> C | No |
| 413 | G -> C | Yes |
| 707 | C -> T | Yes |
| 708 | C -> A | Yes |
| 715 | A -> G | Yes |
| 730 | A -> C | No |
| 730 | A -> G | No |
| 746 | T -> C | Yes |
| 767 | C -> T | No |
| 779 | G -> A | Yes |
| 866 | -> G | No |
| 869 | T -> | No |
| 889 | -> A | No |
| 891 | A -> C | No |
| 891 | A -> G | No |
| 905 | T -> C | No |
| 910 | -> G | No |
| 910 | -> T | No |
| 997 | A -> G | No |
| 1026 | G -> C | No |
| 1042 | -> G | No |
| 1042 | -> T | No |
| 1071 | A -> | No |
| 1071 | A -> C | No |
| 1098 | A -> | No |
| 1105 | C -> T | No |
| 1124 | -> G | No |
| 1135 | G -> A | Yes |
| 1136 | T -> | No |
| 1136 | T -> G | No |
| 1173 | A -> C | No |
| 1173 | A -> G | No |
| 1179 | A -> G | No |
| 1214 | C -> T | Yes |
| 1246 | T -> | No |
| 1246 | T -> A | No |
| 1359 | A -> | No |
| 1359 | A -> G | No |
| 1362 | T -> | No |
| 1365 | C -> T | Yes |
| 1366 | G -> A | Yes |
| 1408 | A -> C | No |
| 1418 | A -> C | No |
| 1433 | A -> C | No |
| 1456 | A -> C | No |
| 1524 | T -> A | No |
| 1524 | T -> C | No |
| 1547 | A -> G | Yes |
| 1553 | T -> | No |
| 1574 | -> G | No |
| 1654 | A -> C | Yes |
| 1691 | A -> G | No |
| 1703 | A -> C | Yes |
| 1755 | A -> C | No |
| 1764 | T -> | No |

Variant protein HUMOSTRO_PEA_1_PEA_1_P25 (SEQ ID NO:1628) according to the present invention has an amino acid sequence as given at the end of the application; it is encoded by transcript(s) HUMOSTRO_PEA_1_PEA_1_T16 (SEQ ID NO:142). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P25 (SEQ ID NO:1628) and OSTP_HUMAN (SEQ ID NO:1462):

1. An isolated chimeric polypeptide encoding for HUMOSTRO_PEA_1_PEA_1_P25 (SEQ ID NO:1628), comprising a first amino acid sequence being at least 90% homologous to MRIAVICFCLLGITCAIPVKQADSGS-SEEKQ corresponding to amino acids 1-31 of OSTP_HUMAN (SEQ ID NO:1462), which also corresponds to amino acids 1-31 of HUMOSTRO_PEA_1_PEA_1_P25 (SEQ ID NO:1628), and a second amino acid sequence being at least 70%, optionally at least 80%, preferably at least 85%, more preferably at least 90% and most preferably at least 95% homologous to a polypeptide having the sequence H corresponding to amino acids 32-32 of HUMOSTRO_PEA_1_PEA_1_P25 (SEQ ID NO:1628), wherein said first amino acid sequence and second amino acid sequence are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P25 (SEQ ID NO:1628) also has the following non-silent SNPs (Single Nucleotide Polymorphisms) as listed in Table 1202, (given according to their position(s) on the amino acid sequence, with the alternative amino acid(s) listed; the last column indicates whether the SNP is known or not; the presence of known SNPs in variant protein HUMOSTRO_PEA_1_PEA_1_P25 (SEQ ID NO:1628) sequence provides support for the deduced sequence of this variant protein according to the present invention).

TABLE 1202

Amino acid mutations

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P25 (SEQ ID NO:1628), as compared to the known protein Osteopontin precursor (SEQ ID NO:1462), are described in Table 1203 (given according to their position(s) on the amino acid sequence in the first column; the second column indicates whether the glycosylation site is present in the variant protein; and the last column indicates whether the position is different on the variant protein).

TABLE 1203

| Glycosylation site(s) | |
|---|---|
| Position(s) on known amino acid sequence | Present in variant protein? |
| 79 | no |
| 106 | no |

Variant protein HUMOSTRO_PEA_1_PEA_1_P25 (SEQ ID NO:1628) is encoded by the following transcript(s): HUMOSTRO_PEA_1_PEA_1_T16 (SEQ ID NO:142), for which the sequence(s) is/are given at the end of the application. The coding portion of transcript HUMOSTRO_PEA_1_PEA_1_T16 (SEQ ID NO:142) is shown in bold; this coding portion starts at position 199 and ends at position 294. The transcript also has the following SNPs as listed in Table 1204 (given according to their position on the nucleotide sequence, with the alternative nucleic acid listed; the last column indicates whether the SNP is known or not; the presence of known SNPs in variant protein HUMOSTRO_PEA_1_PEA_1_P25 (SEQ ID NO:1628) sequence provides support for the deduced sequence of this variant protein according to the present invention).

TABLE 1204

| Nucleic acid SNPs | | |
|---|---|---|
| SNP position on nucleotide sequence | Alternative nucleic acid | Previously known SNP? |
| 136 | A-> G | Yes |
| 154 | T-> | No |
| 159 | G-> T | Yes |
| 219 | C-> G | No |
| 274 | -> G | No |
| 290 | A-> G | No |
| 419 | C-> T | Yes |
| 454 | G-> C | Yes |
| 527 | A-> T | Yes |
| 532 | T-> C | No |
| 630 | C-> T | Yes |
| 631 | C-> A | Yes |
| 638 | A-> G | Yes |
| 653 | A-> C | No |
| 653 | A-> G | No |
| 669 | T-> C | Yes |
| 690 | C-> T | No |
| 702 | G-> A | Yes |
| 789 | -> G | No |
| 792 | T-> | No |
| 812 | -> A | No |
| 814 | A-> C | No |
| 814 | A-> G | No |
| 828 | T-> C | No |
| 833 | -> G | No |
| 833 | -> T | No |
| 920 | A-> G | No |
| 949 | G-> C | No |
| 965 | -> G | No |
| 965 | -> T | No |
| 994 | A-> | No |
| 994 | A-> C | No |
| 1021 | A-> | No |
| 1028 | C-> T | No |
| 1047 | -> G | No |
| 1058 | G-> A | Yes |
| 1059 | T-> | No |
| 1059 | T-> G | No |
| 1096 | A-> C | No |
| 1096 | A-> G | No |
| 1102 | A-> G | No |
| 1137 | C-> T | Yes |
| 1169 | T-> | No |

TABLE 1204-continued

| Nucleic acid SNPs | | |
|---|---|---|
| SNP position on nucleotide sequence | Alternative nucleic acid | Previously known SNP? |
| 1169 | T-> A | No |
| 1282 | A-> | No |
| 1282 | A-> G | No |
| 1285 | T-> | No |
| 1288 | C-> T | Yes |
| 1289 | G-> A | Yes |
| 1331 | A-> C | No |
| 1341 | A-> C | No |
| 1356 | A-> C | No |
| 1379 | A-> C | No |
| 1447 | T-> A | No |
| 1447 | T-> C | No |
| 1470 | A-> G | Yes |
| 1476 | T-> | No |
| 1497 | -> G | No |
| 1577 | A-> C | Yes |
| 1614 | A-> G | No |
| 1626 | A-> C | Yes |
| 1678 | A-> C | No |
| 1687 | | No |

Variant protein HUMOSTRO_PEA_1_PEA_1_P30 (SEQ ID NO:1629) according to the present invention has an amino acid sequence as given at the end of the application; it is encoded by transcript(s) HUMOSTRO_PEA_1_PEA_1_T30 (SEQ ID NO:143). An alignment is given to the known protein (Osteopontin precursor (SEQ ID NO:1462)) at the end of the application. One or more alignments to one or more previously published protein sequences are given at the end of the application. A brief description of the relationship of the variant protein according to the present invention to each such aligned protein is as follows:

Comparison report between HUMOSTRO_PEA_1_PEA_1_P30 (SEQ ID NO:1629) and OSTP_HUMAN (SEQ ID NO:1462):

1. An isolated chimeric polypeptide encoding for HUMOSTRO_PEA_1_PEA_1_P30 (SEQ ID NO:1629), comprising a first amino acid sequence being at least 90% homologous to MRIAVICFCLLGITCAIPVKQADSGS-SEEKQ corresponding to amino acids 1-31 of OSTP_HUMAN (SEQ ID NO:1462), which also corresponds to amino acids 1-31 of HUMOSTRO_PEA_1_PEA_1_P30 (SEQ ID NO:1629), and a second amino acid sequence being at least 70%, optionally at least 80%, preferably at least 85%, more preferably at least 90% and most preferably at least 95% homologous to a polypeptide having the sequence VSIFYVFI (SEQ ID NO: 262) corresponding to amino acids 32-39 of HUMOSTRO_PEA_1_PEA_1_P30 (SEQ ID NO:1629), wherein said first amino acid sequence and second amino acid sequence are contiguous and in a sequential order.

2. An isolated polypeptide encoding for a tail of HUMOSTRO_PEA_1_PEA_1_P30 (SEQ ID NO:1629), comprising a polypeptide being at least 70%, optionally at least about 80%, preferably at least about 85%, more preferably at least about 90% and most preferably at least about 95% homologous to the sequence VSIFYVFI (SEQ ID NO: 262) in HUMOSTRO_PEA_1_PEA_1_P30 (SEQ ID NO:1629).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMOSTRO_PEA_1_PEA_1_P30 (SEQ ID NO:1629) also has the following non-silent SNPs (Single Nucleotide Polymorphisms) as listed in Table 1205, (given according to their position(s) on the amino acid sequence, with the alternative amino acid(s) listed; the last column indicates whether the SNP is known or not; the presence of known SNPs in variant protein HUMOSTRO_PEA_1_PEA_1_P30 (SEQ ID NO:1629) sequence provides support for the deduced sequence of this variant protein according to the present invention).

TABLE 1205

Amino acid mutations

| SNP position(s) on amino acid sequence | Alternative amino acid(s) | Previously known SNP? |
|---|---|---|
| 7 | C -> W | No |
| 31 | Q -> R | No |

The glycosylation sites of variant protein HUMOSTRO_PEA_1_PEA_1_P30 (SEQ ID NO:1629), as compared to the known protein Osteopontin precursor (SEQ ID NO:1462), are described in Table 1206 (given according to their position(s) on the amino acid sequence in the first column; the second column indicates whether the glycosylation site is present in the variant protein; and the last column indicates whether the position is different on the variant protein).

TABLE 1206

Glycosylation site(s)

| Position(s) on known amino acid sequence | Present in variant protein? |
|---|---|
| 79 | no |
| 106 | no |

Variant protein HUMOSTRO_PEA_1_PEA_1_P30 (SEQ ID NO:1629) is encoded by the following transcript(s): HUMOSTRO_PEA_1_PEA_1_T30 (SEQ ID NO:143), for which the sequence(s) is/are given at the end of the application. The coding portion of transcript HUMOSTRO_PEA_1_PEA_1_T30 (SEQ ID NO:143) is shown in bold; this coding portion starts at position 199 and ends at position 315. The transcript also has the following SNPs as listed in Table 1207 (given according to their position on the nucleotide sequence, with the alternative nucleic acid listed; the last column indicates whether the SNP is known or not; the presence of known SNPs in variant protein HUMOSTRO_PEA_1_PEA_1_P30 (SEQ ID NO:1629) sequence provides support for the deduced sequence of this variant protein according to the present invention).

TABLE 1207

Nucleic acid SNPs

| SNP position on nucleotide sequence | Alternative nucleic acid | Previously known SNP? |
|---|---|---|
| 136 | A -> G | Yes |
| 154 | T -> | No |

TABLE 1207-continued

Nucleic acid SNPs

| SNP position on nucleotide sequence | Alternative nucleic acid | Previously known SNP? |
|---|---|---|
| 159 | G -> T | Yes |
| 219 | C -> G | No |
| 274 | -> G | No |
| 290 | A -> G | No |

As noted above, cluster HUMOSTRO features 30 segment(s), which were listed in Table 1194 above and for which the sequence(s) are given at the end of the application. These segment(s) are portions of nucleic acid sequence(s) which are described herein separately because they are of particular interest. A description of each segment according to the present invention is now provided.

Segment cluster HUMOSTRO_PEA_1_PEA_1_node_0 (SEQ ID NO:961) according to the present invention is supported by 333 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T6 (SEQ ID NO:142) and HUMOSTRO_PEA_1_PEA_1_T30 (SEQ ID NO:143). Table 1208 below describes the starting and ending position of this segment on each transcript.

TABLE 1208

Segment location on transcripts

| Transcript name | Segment starting position | Segment ending position |
|---|---|---|
| HUMOSTRO_PEA_1_PEA_1_T14 (SEQ ID NO:141) | 1 | 184 |
| HUMOSTRO_PEA_1_PEA_1_T16 (SEQ ID NO:142) | 1 | 184 |
| HUMOSTRO_PEA_1_PEA_1_T30 (SEQ ID NO:143) | 1 | 184 |

Segment cluster HUMOSTRO_PEA_1_PEA_1_node_10 (SEQ ID NO:962) according to the present invention is supported by 4 libraries. The number of libraries was determined as previously described. This segment can be found in the following transcript(s): HUMOSTRO_PEA_1_PEA_1_T16 (SEQ ID NO:142). Table 1209 below describes the starting and ending position of this segment on each transcript.

TABLE 1209

Segment location on transcripts

| Transcript name | Segment starting position | Segment ending position |
|---|---|---|
| HUMOSTRO_PEA_1_PEA_1_T16 (SEQ ID NO:142) | 292 | 480 |

Segment cluster HUMOSTRO_PEA_1_PEA_1_node_16 (SEQ ID NO:963) according to the present invention is supported by 6 libraries. The number of libraries was determined as previously described. This segment can be found in the following transcript(s): HUMOSTRO_PEA_1_PEA_

1_T14 (SEQ ID NO:141). Table 1210 below describes the starting and ending position of this segment on each transcript.

TABLE 1210

Segment location on transcripts

| Transcript name | Segment starting position | Segment ending position |
|---|---|---|
| HUMOSTRO_PEA_1_PEA_1_T14 (SEQ ID NO:141) | 373 | 638 |

Segment cluster HUMOSTRO_PEA_1_PEA_1_node_23 (SEQ ID NO:964) according to the present invention is supported by 334 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1211 below describes the starting and ending position of this segment on each transcript.

TABLE 1211

Segment location on transcripts

| Transcript name | Segment starting position | Segment ending position |
|---|---|---|
| HUMOSTRO_PEA_1_PEA_1_T14 (SEQ ID NO:141) | 804 | 967 |
| HUMOSTRO_PEA_1_PEA_1_T16 (SEQ ID NO:142) | 727 | 890 |

Segment cluster HUMOSTRO_PEA_1_PEA_1_node_31 (SEQ ID NO:965) according to the present invention is supported by 350 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1212 below describes the starting and ending position of this segment on each transcript.

TABLE 1212

Segment location on transcripts

| Transcript name | Segment starting position | Segment ending position |
|---|---|---|
| HUMOSTRO_PEA_1_PEA_1_T14 (SEQ ID NO:141) | 1164 | 1393 |
| HUMOSTRO_PEA_1_PEA_1_T16 (SEQ ID NO:142) | 1087 | 1316 |

Segment cluster HUMOSTRO_PEA_1_PEA_1_node_43 (SEQ ID NO:966) according to the present invention is supported by 192 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1213 below describes the starting and ending position of this segment on each transcript.

TABLE 1213

Segment location on transcripts

| Transcript name | Segment starting position | Segment ending position |
|---|---|---|
| HUMOSTRO_PEA_1_PEA_1_T14 (SEQ ID NO:141) | 1810 | 1846 |
| HUMOSTRO_PEA_1_PEA_1_T16 (SEQ ID NO:142) | 1733 | 1769 |

According to an optional embodiment of the present invention, short segments related to the above cluster are also provided. These segments are up to about 120 bp in length, and so are included in a separate description.

Segment cluster HUMOSTRO_PEA_1_PEA_1_node_3 (SEQ ID NO:967) according to the present invention is supported by 353 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1214 below describes the starting and ending position of this segment on each transcript.

TABLE 1214

Segment location on transcripts

| Transcript name | Segment starting position | Segment ending position |
|---|---|---|
| HUMOSTRO_PEA_1_PEA_1_T14 (SEQ ID NO:141) | 185 | 210 |
| HUMOSTRO_PEA_1_PEA_1_T16 (SEQ ID NO:142) | 185 | 210 |
| HUMOSTRO_PEA_1_PEA_1_T30 (SEQ ID NO:143) | 185 | 210 |

Segment cluster HUMOSTRO_PEA_1_PEA_1_node_5 (SEQ ID NO:968) according to the present invention is supported by 353 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1215 below describes the starting and ending position of this segment on each transcript.

TABLE 1215

Segment location on transcripts

| Transcript name | Segment starting position | Segment ending position |
|---|---|---|
| HUMOSTRO_PEA_1_PEA_1_T14 (SEQ ID NO:141) | 211 | 252 |
| HUMOSTRO_PEA_1_PEA_1_T16 (SEQ ID NO:142) | 211 | 252 |
| HUMOSTRO_PEA_1_PEA_1_T30 (SEQ ID NO:143) | 211 | 252 |

Segment cluster HUMOSTRO_PEA_1_PEA_1_node_7 (SEQ ID NO:969) according to the present invention is supported by 357 libraries. The number of libraries was determined as previously described. This segment can be found in the following transcript(s): HUMOSTRO_PEA_1_PEA_1_T14 (SEQ ID NO:141), HUMOSTRO_PEA_1_PEA_1_T16 (SEQ ID NO:142) and HUMOSTRO_PEA_1_PEA_1_T30 (SEQ ID NO:143). Table 1216 below describes the starting and ending position of this segment on each transcript.

TABLE 1216

Segment location on transcripts

| Transcript name | Segment starting position | Segment ending position |
|---|---|---|
| HUMOSTRO_PEA_1_PEA_1_T14 (SEQ ID NO:141) | 253 | 291 |
| HUMOSTRO_PEA_1_PEA_1_T16 (SEQ ID NO:142) | 253 | 291 |
| HUMOSTRO_PEA_1_PEA_1_T30 (SEQ ID NO:143) | 253 | 291 |

Segment cluster HUMOSTRO_PEA_1_PEA_1_node_8 (SEQ ID NO:970) according to the present invention is supported by 1 libraries. The number of libraries was determined as previously described. This segment can be found in the following transcript(s): HUMOSTRO_PEA_1_PEA_1_T30 (SEQ ID NO:143). Table 1217 below describes the starting and ending position of this segment on each transcript.

TABLE 1217

Segment location on transcripts

| Transcript name | Segment starting position | Segment ending position |
|---|---|---|
| HUMOSTRO_PEA_1_PEA_1_T30 (SEQ ID NO:143) | 292 | 378 |

Segment cluster HUMOSTRO_PEA_1_PEA_1_node_15 (SEQ ID NO:971) according to the present invention is supported by 366 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1218 below describes the starting and ending position of this segment on each transcript.

TABLE 1218

Segment location on transcripts

| Transcript name | Segment starting position | Segment ending position |
|---|---|---|
| HUMOSTRO_PEA_1_PEA_1_T14 (SEQ ID NO:141) | 292 | 372 |
| HUMOSTRO_PEA_1_PEA_1_T16 (SEQ ID NO:142) | 481 | 561 |

Segment cluster HUMOSTRO_PEA_1_PEA_1_node_17 (SEQ ID NO:972) according to the present invention is supported by 261 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1219 below describes the starting and ending position of this segment on each transcript.

TABLE 1219

Segment location on transcripts

| Transcript name | Segment starting position | Segment ending position |
|---|---|---|
| HUMOSTRO_PEA_1_PEA_1_T14 (SEQ ID NO:141) | 639 | 680 |
| HUMOSTRO_PEA_1_PEA_1_T16 (SEQ ID NO:142) | 562 | 603 |

Segment cluster HUMOSTRO_PEA_1_PEA_1_node_20 (SEQ ID NO:973) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1220 below describes the starting and ending position of this segment on each transcript.

TABLE 1220

Segment location on transcripts

| Transcript name | Segment starting position | Segment ending position |
|---|---|---|
| HUMOSTRO_PEA_1_PEA_1_T14 (SEQ ID NO:141) | 681 | 688 |
| HUMOSTRO_PEA_1_PEA_1_T16 (SEQ ID NO:142) | 604 | 611 |

Segment cluster HUMOSTRO_PEA_1_PEA_1_node_21 (SEQ ID NO:974) according to the present invention is supported by 315 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1221 below describes the starting and ending position of this segment on each transcript.

TABLE 1221

Segment location on transcripts

| Transcript name | Segment starting position | Segment ending position |
|---|---|---|
| HUMOSTRO_PEA_1_PEA_1_T14 (SEQ ID NO:141) | 689 | 738 |
| HUMOSTRO_PEA_1_PEA_1_T16 (SEQ ID NO:142) | 612 | 661 |

Segment cluster HUMOSTRO_PEA_1_PEA_1_node_22 (SEQ ID NO:975) according to the present invention is supported by 322 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1222 below describes the starting and ending position of this segment on each transcript.

TABLE 1222

Segment location on transcripts

| Transcript name | Segment starting position | Segment ending position |
|---|---|---|
| HUMOSTRO_PEA_1_PEA_1_T14 (SEQ ID NO:141) | 739 | 803 |
| HUMOSTRO_PEA_1_PEA_1_T16 (SEQ ID NO:142) | 662 | 726 |

Segment cluster HUMOSTRO_PEA_1_PEA_1_node_24 (SEQ ID NO:976) according to the present invention is supported by 270 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1223 below describes the starting and ending position of this segment on each transcript.

TABLE 1223

Segment location on transcripts

| Transcript name | Segment starting position | Segment ending position |
|---|---|---|
| HUMOSTRO_PEA_1_PEA_1_T14 (SEQ ID NO:141) | 968 | 1004 |
| HUMOSTRO_PEA_1_PEA_1_T16 (SEQ ID NO:142) | 891 | 927 |

Segment cluster HUMOSTRO_PEA_1_PEA_1_node_26 (SEQ ID NO:977) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1224 below describes the starting and ending position of this segment on each transcript.

TABLE 1224

Segment location on transcripts

| Transcript name | Segment starting position | Segment ending position |
|---|---|---|
| HUMOSTRO_PEA_1_PEA_1_T14 (SEQ ID NO:141) | 1005 | 1022 |
| HUMOSTRO_PEA_1_PEA_1_T16 (SEQ ID NO:142) | 928 | 945 |

Segment cluster HUMOSTRO_PEA_1_PEA_1_node_27 (SEQ ID NO:978) according to the present invention is supported by 260 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1225 below describes the starting and ending position of this segment on each transcript.

TABLE 1225

Segment location on transcripts

| Transcript name | Segment starting position | Segment ending position |
|---|---|---|
| HUMOSTRO_PEA_1_PEA_1_T14 (SEQ ID NO:141) | 1023 | 1048 |
| HUMOSTRO_PEA_1_PEA_1_T16 (SEQ ID NO:142) | 946 | 971 |

Segment cluster HUMOSTRO_PEA_1_PEA_1_node_28 (SEQ ID NO:979) according to the present invention is supported by 273 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1226 below describes the starting and ending position of this segment on each transcript.

TABLE 1226

Segment location on transcripts

| Transcript name | Segment starting position | Segment ending position |
|---|---|---|
| HUMOSTRO_PEA_1_PEA_1_T14 (SEQ ID NO:141) | 1049 | 1100 |
| HUMOSTRO_PEA_1_PEA_1_T16 (SEQ ID NO:142) | 972 | 1023 |

Segment cluster HUMOSTRO_PEA_1_PEA_1_node_29 (SEQ ID NO:980) according to the present invention is supported by 272 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1227 below describes the starting and ending position of this segment on each transcript.

TABLE 1227

Segment location on transcripts

| Transcript name | Segment starting position | Segment ending position |
|---|---|---|
| HUMOSTRO_PEA_1_PEA_1_T14 (SEQ ID NO:141) | 1101 | 1151 |
| HUMOSTRO_PEA_1_PEA_1_T16 (SEQ ID NO:142) | 1024 | 1074 |

Segment cluster HUMOSTRO_PEA_1_PEA_1_node_30 (SEQ ID NO:981) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1228 below describes the starting and ending position of this segment on each transcript.

TABLE 1228

Segment location on transcripts

| Transcript name | Segment starting position | Segment ending position |
|---|---|---|
| HUMOSTRO_PEA_1_PEA_1_T14 (SEQ ID NO:141) | 1152 | 1163 |
| HUMOSTRO_PEA_1_PEA_1_T16 (SEQ ID NO:142) | 1075 | 1086 |

Segment cluster HUMOSTRO_PEA_1_PEA_1_node_32 (SEQ ID NO:982) according to the present invention is supported by 293 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1229 below describes the starting and ending position of this segment on each transcript.

TABLE 1229

Segment location on transcripts

| Transcript name | Segment starting position | Segment ending position |
|---|---|---|
| HUMOSTRO_PEA_1_PEA_1_T14 (SEQ ID NO:141) | 1394 | 1427 |
| HUMOSTRO_PEA_1_PEA_1_T16 (SEQ ID NO:142) | 1317 | 1350 |

Segment cluster HUMOSTRO_PEA_1_PEA_1_node_34 (SEQ ID NO:983) according to the present invention is supported by 301 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1230 below describes the starting and ending position of this segment on each transcript.

TABLE 1230

Segment location on transcripts

| Transcript name | Segment starting position | Segment ending position |
|---|---|---|
| HUMOSTRO_PEA_1_PEA_1_T14 (SEQ ID NO:141) | 1428 | 1468 |
| HUMOSTRO_PEA_1_PEA_1_T16 (SEQ ID NO:142) | 1351 | 1391 |

Segment cluster HUMOSTRO_PEA_1_PEA_1_node_36 (SEQ ID NO:984) according to the present invention is supported by 292 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1231 below describes the starting and ending position of this segment on each transcript.

TABLE 1231

Segment location on transcripts

| Transcript name | Segment starting position | Segment ending position |
|---|---|---|
| HUMOSTRO_PEA_1_PEA_1_T14 (SEQ ID NO:141) | 1469 | 1504 |
| HUMOSTRO_PEA_1_PEA_1_T16 (SEQ ID NO:142) | 1392 | 1427 |

Segment cluster HUMOSTRO_PEA_1_PEA_1_node_37 (SEQ ID NO:985) according to the present invention is supported by 295 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1232 below describes the starting and ending position of this segment on each transcript.

TABLE 1232

Segment location on transcripts

| Transcript name | Segment starting position | Segment ending position |
|---|---|---|
| HUMOSTRO_PEA_1_PEA_1_T14 (SEQ ID NO:141) | 1505 | 1623 |
| HUMOSTRO_PEA_1_PEA_1_T16 (SEQ ID NO:142) | 1428 | 1546 |

Segment cluster HUMOSTRO_PEA_1_PEA_1_node_38 (SEQ ID NO:986) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1233 below describes the starting and ending position of this segment on each transcript.

TABLE 1233

Segment location on transcripts

| Transcript name | Segment starting position | Segment ending position |
|---|---|---|
| HUMOSTRO_PEA_1_PEA_1_T14 (SEQ ID NO:141) | 1624 | 1634 |
| HUMOSTRO_PEA_1_PEA_1_T16 (SEQ ID NO:142) | 1547 | 1557 |

Segment cluster HUMOSTRO_PEA_1_PEA_1_node_39 (SEQ ID NO:987) according to the present invention is supported by 268 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1234 below describes the starting and ending position of this segment on each transcript.

TABLE 1234

Segment location on transcripts

| Transcript name | Segment starting position | Segment ending position |
|---|---|---|
| HUMOSTRO_PEA_1_PEA_1_T14 (SEQ ID NO:141) | 1635 | 1725 |
| HUMOSTRO_PEA_1_PEA_1_T16 (SEQ ID NO:142) | 1558 | 1648 |

Segment cluster HUMOSTRO_PEA_1_PEA_1_node_40 (SEQ ID NO:988) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1235 below describes the starting and ending position of this segment on each transcript.

TABLE 1235

Segment location on transcripts

| Transcript name | Segment starting position | Segment ending position |
|---|---|---|
| HUMOSTRO_PEA_1_PEA_1_T14 (SEQ ID NO:141) | 1726 | 1743 |
| HUMOSTRO_PEA_1_PEA_1_T16 (SEQ ID NO:142) | 1649 | 1666 |

Segment cluster HUMOSTRO_PEA_1_PEA_1_node_41 (SEQ ID NO:989) according to the present invention can be found in the following transcript(s): HUMOSTRO_PEA_1_PEA_1_T14 (SEQ ID NO:141) and HUMOSTRO_PEA_1_PEA_1_T16 (SEQ ID NO:142). Table 1236 below describes the starting and ending position of this segment on each transcript.

TABLE 1236

Segment location on transcripts

| Transcript name | Segment starting position | Segment ending position |
|---|---|---|
| HUMOSTRO_PEA_1_PEA_1_T14 (SEQ ID NO:141) | 1744 | 1749 |
| HUMOSTRO_PEA_1_PEA_1_T16 (SEQ ID NO:142) | 1667 | 1672 |

Segment cluster HUMOSTRO_PEA_1_PEA_1_node_42 (SEQ ID NO:990) according to the present invention is supported by 224 libraries. The number of libraries was determined as previously described. This segment can be found in the following transcript(s): HUMOSTRO_PEA_1_PEA_1_T14 (SEQ ID NO:141) and HUMOSTRO_PEA_1_PEA_1_T16 (SEQ ID NO:142). Table 1237 below describes the starting and ending position of this segment on each transcript.

TABLE 1237

Segment location on transcripts

| Transcript name | Segment starting position | Segment ending position |
|---|---|---|
| HUMOSTRO_PEA_1_PEA_1_T14 (SEQ ID NO:141) | 1750 | 1809 |
| HUMOSTRO_PEA_1_PEA_1_T16 (SEQ ID NO:142) | 1673 | 1732 |

Variant protein alignment to the previously known protein:

Sequence name: OSTP_HUMAN (SEQ ID NO:1462)

Sequence documentation:

Alignment of: HUMOSTRO_PEA_1_PEA_1_P21 (SEQ ID NO:1627) x OSTP_HUMAN (SEQ ID NO:1462) . . .

Alignment segment 1/1:

| | |
|---|---|
| Quality: 578.00 | Escore: 0 |
| Matching length: 58 | Total length: 58 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MRIAVICFCLLGITCAIPVKQADSGSSEEKQLYNKYPDAVATWLNPDPSQ  50
    ||||||||||||||||||||||||||||||||||||||||||||||||||
 1  MRIAVICFCLLGITCAIPVKQADSGSSEEKQLYNKYPDAVATWLNPDPSQ  50

51  KQNLLAPQ  58
    ||||||||
51  KQNLLAPQ  58
```

Sequence name: OSTP_HUMAN (SEQ ID NO:1462)

Sequence documentation:

Alignment of: HUMOSTRO_PEA_1_PEA_1_P25 (SEQ ID NO:1628) x OSTP_HUMAN (SEQ ID NO:1462) . . .

Alignment segment 1/1:

Quality: 301.00  Escore: 0
Matching length: 31  Total length: 31
Matching Percent Similarity: 100.00  Matching Percent Identity: 100.00
Total Percent Similarity: 100.00  Total Percent Identity: 100.00
Gaps: 0

Alignment:

```
1  MRIAVICFCLLGITCAIPVKQADSGSSEEKQ              31
   ||||||||||||||||||||||||||||||
1  MRIAVICFCLLGITCAIPVKQADSGSSEEKQ              31
```

Sequence name: OSTP_HUMAN (SEQ ID NO:1462)

Sequence documentation:

Alignment of: HUMOSTRO_PEA_1_PEA_1_P30 (SEQ ID NO:1629) x OSTP_HUMAN (SEQ ID NO:1462) . . .

Alignment segment 1/1:

Quality: 301.00  Escore: 0
Matching length: 31  Total length: 31
Matching Percent Similarity: 100.00  Matching Percent Identity: 100.00
Total Percent Similarity: 100.00  Total Percent Identity: 100.00
Gaps: 0

Alignment:

```
1  MRIAVICFCLLGITCAIPVKQADSGSSEEKQ              31
   ||||||||||||||||||||||||||||||
1  MRIAVICFCLLGITCAIPVKQADSGSSEEKQ              31
```

Description for Cluster R11723

Cluster R11723 features 6 transcript(s) and 26 segment(s) of interest, the names for which are given in Tables 1238 and 1239, respectively, the sequences themselves are given at the end of the application. The selected protein variants are given in table 1240.

TABLE 1238

Transcripts of interest

| Transcript Name | Sequence ID No. |
|---|---|
| R11723_PEA_1_T15 | 144 |
| R11723_PEA_1_T17 | 145 |
| R11723_PEA_1_T19 | 146 |
| R11723_PEA_1_T20 | 147 |
| R11723_PEA_1_T5 | 148 |
| R11723_PEA_1_T6 | 149 |

TABLE 1239

Segments of interest

| Segment Name | Sequence ID No. |
|---|---|
| R11723_PEA_1_node_13 | 991 |
| R11723_PEA_1_node_16 | 992 |
| R11723_PEA_1_node_19 | 993 |
| R11723_PEA_1_node_2 | 994 |
| R11723_PEA_1_node_22 | 995 |
| R11723_PEA_1_node_31 | 996 |
| R11723_PEA_1_node_10 | 997 |
| R11723_PEA_1_node_11 | 998 |
| R11723_PEA_1_node_15 | 999 |
| R11723_PEA_1_node_18 | 1000 |
| R11723_PEA_1_node_20 | 1001 |

TABLE 1239-continued

Segments of interest

| Segment Name | Sequence ID No. |
|---|---|
| R11723_PEA_1_node_21 | 1002 |
| R11723_PEA_1_node_23 | 1003 |
| R11723_PEA_1_node_24 | 1004 |
| R11723_PEA_1_node_25 | 1005 |
| R11723_PEA_1_node_26 | 1006 |
| R11723_PEA_1_node_27 | 1007 |
| R11723_PEA_1_node_28 | 1008 |
| R11723_PEA_1_node_29 | 1009 |

TABLE 1239-continued

Segments of interest

| Segment Name | Sequence ID No. |
|---|---|
| R11723_PEA_1_node_3 | 1010 |
| R11723_PEA_1_node_30 | 1011 |
| R11723_PEA_1_node_4 | 1012 |
| R11723_PEA_1_node_5 | 1013 |
| R11723_PEA_1_node_6 | 1014 |
| R11723_PEA_1_node_7 | 1015 |
| R11723_PEA_1_node_8 | 1016 |

TABLE 1240

Proteins of interest

| Protein Name | Sequence ID No. |
|---|---|
| R11723_PEA_1_P2 | 1409 |
| R11723_PEA_1_P6 | 1410 |

TABLE 1240-continued

Proteins of interest

| Protein Name | Sequence ID No. |
| --- | --- |
| R11723_PEA_1_P7 | 1411 |
| R11723_PEA_1_P13 | 1412 |
| R11723_PEA_1_P10 | 1413 |

Cluster R11723 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 47 refer to weighted expression of ESTs in each category, as "parts per million" (ratio of the expression of ESTs for a particular cluster to the expression of all ESTs in that category, according to parts per million).

Figure 47:
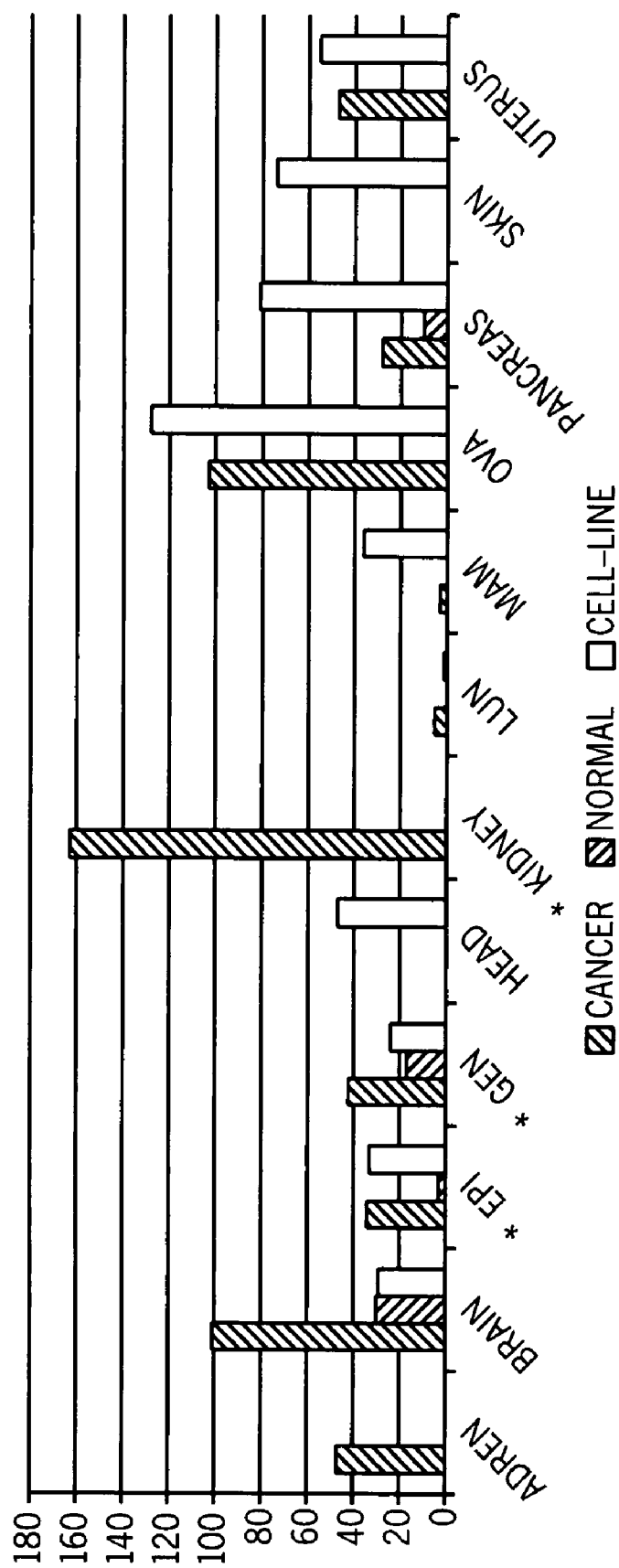
FIG. 47 is a histogram showing Cancer and cell-line vs. normal tissue expression for Cluster HUMOSTRO, demonstrating overexpression in epithelial malignant tumors, a mixture of malignant tumors from different tissues and kidney malignant tumors.

Overall, the following results were obtained as shown with regard to the histograms in FIG. 47 and Table 1241. This cluster is overexpressed (at least at a minimum level) in the following pathological conditions: epithelial malignant tumors, a mixture of malignant tumors from different tissues and kidney malignant tumors.

TABLE 1241

Normal tissue distribution

| Name of Tissue | Number |
| --- | --- |
| Adrenal | 0 |
| Brain | 30 |
| Epithelial | 3 |
| General | 17 |
| head and neck | 0 |
| Kidney | 0 |
| Lung | 0 |
| Breast | 0 |
| Ovary | 0 |
| Pancreas | 10 |
| Skin | 0 |
| Uterus | 0 |

TABLE 1242

P values and ratios for expression in cancerous tissue

| Name of Tissue | P1 | P2 | SP1 | R3 | SP2 | R4 |
| --- | --- | --- | --- | --- | --- | --- |
| Adrenal | 4.2e-01 | 4.6e-01 | 4.6e-01 | 2.2 | 5.3e-01 | 1.9 |
| Brain | 2.2e-01 | 2.0e-01 | 1.2e-02 | 2.8 | 5.0e-02 | 2.0 |
| Epithelial | 3.0e-05 | 6.3e-05 | 1.8e-05 | 6.3 | 3.4e-06 | 6.4 |
| General | 7.2e-03 | 4.0e-02 | 1.3e-04 | 2.1 | 1.1e-03 | 1.7 |
| head and neck | 1 | 5.0e-01 | 1 | 1.0 | 7.5e-01 | 1.3 |
| Kidney | 1.5e-01 | 2.4e-01 | 4.4e-03 | 5.4 | 2.8e-02 | 3.6 |
| Lung | 1.2e-01 | 1.6e-01 | 1 | 1.6 | 1 | 1.3 |
| Breast | 5.9e-01 | 4.4e-01 | 1 | 1.1 | 6.8e-01 | 1.5 |
| Ovary | 1.6e-02 | 1.3e-02 | 1.0e-01 | 3.8 | 7.0e-02 | 3.5 |
| Pancreas | 5.5e-01 | 2.0e-01 | 3.9e-01 | 1.9 | 1.4e-01 | 2.7 |
| Skin | 1 | 4.4e-01 | 1 | 1.0 | 1.9e-02 | 2.1 |
| Uterus | 1.5e-02 | 5.4e-02 | 1.9e-01 | 3.1 | 1.4e-01 | 2.5 |

As noted above, contig R11723 features 6 transcript(s), which were listed in Table 1238 above. A description of each variant protein according to the present invention is now provided.

Variant protein R11723_PEA_1_P2 (SEQ ID NO:1409) according to the present invention has an amino acid sequence as given at the end of the application; it is encoded by transcript(s) R11723_PEA_1_T6 (SEQ ID NO:149). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P2 (SEQ ID NO:1409) also has the following non-silent SNPs (Single Nucleotide Polymorphisms) as listed in Table 1243, (given according to their position(s) on the amino acid sequence, with the alternative amino acid(s) listed; the last column indicates whether the SNP is known or not; the presence of known SNPs in variant protein R11723_PEA_1_P2 (SEQ ID NO:1409) sequence provides support for the deduced sequence of this variant protein according to the present invention).

TABLE 1243

Amino acid mutations

| SNP position(s) on amino acid sequence | Alternative amino acid(s) | Previously known SNP? |
| --- | --- | --- |
| 107 | H -> P | Yes |
| 70 | G -> | No |
| 70 | G -> C | No |

Variant protein R11723_PEA_1_P2 (SEQ ID NO:1409) is encoded by the following transcript(s): R11723_PEA_1_T6 (SEQ ID NO:149), for which the sequence(s) is/are given at the end of the application. The coding portion of transcript R11723_PEA_1_T6 (SEQ ID NO:149) is shown in bold; this coding portion starts at position 1716 and ends at position 2051. The transcript also has the following SNPs as listed in Table 1244 (given according to their position on the nucleotide sequence, with the alternative nucleic acid listed; the last column indicates whether the SNP is known or not; the presence of known SNPs in variant protein R11723_PEA_1_P2 (SEQ ID NO:1409) sequence provides support for the deduced sequence of this variant protein according to the present invention).

TABLE 1244

Nucleic acid SNPs

| SNP position on nucleotide sequence | Alternative nucleic acid | Previously known SNP? |
| --- | --- | --- |
| 1231 | C -> T | Yes |
| 1278 | G -> C | Yes |
| 1923 | G -> | No |
| 1923 | G -> T | No |
| 2035 | A -> C | Yes |
| 2048 | A -> C | No |
| 2057 | A -> G | Yes |

Variant protein R11723_PEA_1_P6 (SEQ ID NO:1410) according to the present invention has an amino acid sequence as given at the end of the application; it is encoded by transcript(s) R11723_PEA_1_T15 (SEQ ID NO:144). One or more alignments to one or more previously published protein sequences are given at the end of the application. A brief description of the relationship of the variant protein according to the present invention to each such aligned protein is as follows:

Comparison report between R11723_PEA_1_P6 (SEQ ID NO:1410) and Q8IXM0 (SEQ ID NO:1707):

1. An isolated chimeric polypeptide encoding for R11723_PEA_1_P6 (SEQ ID NO:1410), comprising a first amino acid sequence being at least 70%, optionally at least 80%, preferably at least 85%, more preferably at least 90% and most preferably at least 95% homologous to a polypeptide having the sequence MWVLGIAATFCGLFLLPGFALQIQCYQCEEFQLNNDCSSPEFIVNCTVNVQDMCQKEVMEQSAGIMYRKS CASSAACLIASAGSPCRGLAPGREEQRALHKAGAVGGGVR (SEQ ID NO: 1741) corresponding to amino acids 1-110 of R11723_PEA_1_P6 (SEQ ID NO:1410), and a second amino acid sequence being at least 90% homologous to MYAQALLVVGVLQRQAAAQHLHEHPPKLLRGHRVQERVDDRAEVEKRLREGEEDHVRPEVGPRPVVLG FGRSHDPPNLVGHPAYGQCHNNQPWADTSRRERQRKEKHSMRTQ corresponding to amino acids 1-112 of Q8IXM0 (SEQ ID NO:1707), which also corresponds to amino acids 111-222 of R11723_PEA_1_P6 (SEQ ID NO:1410), wherein said first and second amino acid sequences are contiguous and in a sequential order.

2. An isolated polypeptide encoding for a head of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence MWVLGIAATFCGLFLLPGFALQIQCYQCEEFQLNNDCSSPEFIVNCTVNVQDMCQKEVMEQSAGIMYRKS CASSAACLIASAGSPCRGLAPGREEQRALHKAGAVGGGVR (SEQ ID NO: 1741) of R11723_PEA_1_P6 (SEQ ID NO:1410).

Comparison report between R11723_PEA_1_P6 (SEQ ID NO:1410) and Q96AC2 (SEQ ID NO:1708):

1. An isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKS CASSAACLIASAG corresponding to amino acids 1-83 of Q96AC2 (SEQ ID NO:1708), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) in R11723_PEA_1_P6 (SEQ ID NO:1410).

Comparison report between R11723_PEA_1_P6 (SEQ ID NO:1410) and Q8N2G4 (SEQ ID NO:1709):

1. An isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKS CASSAACLIASAG corresponding to amino acids 1-83 of Q8N2G4 (SEQ ID NO:1709), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) in R11723_PEA_1_P6 (SEQ ID NO:1410).

Comparison report between R11723_PEA_1_P6 (SEQ ID NO:1410) and BAC85518 (SEQ ID NO:1710):

1. An isolated chimeric polypeptide encoding for R11723_PEA_1_P6 (SEQ ID NO:1410), comprising a first amino acid sequence being at least 90% homologous to MWVLGIAATFCGLFLLPGFALQIQCYQCEEFQLNNDCSSPEFIVNCTVNVQDMCQKEVMEQSAGIMYRKS CASSAACLIASAG corresponding to amino acids 24-106 of BAC85518 (SEQ ID NO:1710), which also corresponds to amino acids 1-83 of R11723_PEA_1_P6 (SEQ ID NO:1410), and a second amino acid sequence being at least 70%, optionally at least 80%, preferably at least 85%, more preferably at least 90% and most preferably at least 95% homologous to a polypeptide having the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) corresponding to amino acids 84-222 of R11723_PEA_1_P6 (SEQ ID NO:1410), wherein said first and second amino acid sequences are contiguous and in a sequential order.

2. An isolated polypeptide encoding for a tail of R11723_PEA_1_P6 (SEQ ID NO:1410), comprising a polypeptide being at least 70%, optionally at least about 80%, preferably at least about 85%, more preferably at least about 90% and most preferably at least about 95% homologous to the sequence SPCRGLAPGREEQRALHKAGAVGGGVRMYAQALLVVGVLQRQAAAQHLHEHPPKLLRGHRVQERVDD RAEVEKRLREGEEDHVRPEVGPRPVVLGFGRSHDPPNLVGHPAYGQCHNNQPWADTSRRERQRKEKHSM RTQ (SEQ ID NO: 1742) in R11723_PEA_1_P6 (SEQ ID NO:1410).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P6 (SEQ ID NO:1410) also has the following non-silent SNPs (Single Nucleotide Polymorphisms) as listed in Table 1245, (given according to their 1271 position(s) on the amino acid sequence, with the alternative amino acid(s) listed; the last column indicates whether the SNP is known or not; the presence of known SNPs invariant protein R11723_PEA_1_P6 (SEQ ID NO:1410) sequence provides support for the deduced sequence of this variant protein according to the present invention).

TABLE 1245

Amino acid mutations

| SNP position(s) on amino acid sequence | Alternative amino acid(s) | Previously known SNP? |
|---|---|---|
| 180 | G -> | No |
| 180 | G -> C | No |
| 217 | H -> P | Yes |

Variant protein R11723_PEA_1_P6 (SEQ ID NO:1410) is encoded by the following transcript(s): R11723_PEA_1_T15 (SEQ ID NO:144), for which the sequence(s) is/are given at the end of the application. The coding portion of transcript R11723_PEA_1_T15 (SEQ ID NO:144) is shown in bold; this coding portion starts at position 434 and ends at position 1099. The transcript also has the following SNPs as listed in Table 1246 (given according to their position on the nucleotide sequence, with the alternative nucleic acid listed; the last column indicates whether the SNP is known or not; the presence of known SNPs in variant protein R11723_PEA_1_P6 (SEQ ID NO:1410) sequence provides support for the deduced sequence of this variant protein according to the present invention).

TABLE 1246

Nucleic acid SNPs

| SNP position on nucleotide sequence | Alternative nucleic acid | Previously known SNP? |
|---|---|---|
| 971 | G -> | No |
| 971 | G -> T | No |
| 1083 | A -> C | Yes |
| 1096 | A -> C | No |
| 1105 | A -> G | Yes |

Variant protein R11723_PEA_1_P7 (SEQ ID NO:1411) according to the present invention has an amino acid sequence as given at the end of the application; it is encoded by transcript(s) R11723_PEA_1_T17 (SEQ ID NO:145). One or more alignments to one or more previously published protein sequences are given at the end of the application. A brief description of the relationship of the variant protein according to the present invention to each such aligned protein is as follows:

Comparison report between R11723_PEA_1_P7 (SEQ ID NO:1411) and Q96AC2 (SEQ ID NO:1708):

1. An isolated chimeric polypeptide encoding for R11723_PEA_1_P7 (SEQ ID NO:1411), comprising a first amino acid sequence being at least 90% homologous to MWVLGLAATFCGLFLLPGFALQIQCYQCEEFQLN-NDCSSPEFIVNCTVNVQDMCQKEVMEQSAG corresponding to amino acids 1-64 of Q96AC2 (SEQ ID NO:1708), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTRLECSGTISAHCN-LCLPGSNDHPT (SEQ ID NO: 1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1743) in R11723_PEA_1_P7 (SEQ ID NO:1411).

Comparison report between R11723_PEA_1_P7 (SEQ ID NO:1411) and Q8N2G4 (SEQ ID NO:1709):

1. An isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMC-QKEVMEQSAG corresponding to amino acids 1-64 of Q8N2G4 (SEQ ID NO:1709), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO:1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1743) in R11723_PEA_1_P7 (SEQ ID NO:1411).

Comparison report between R11723_PEA_1_P7 (SEQ ID NO:1411) and BAC85273:

1. An isolated chimeric polypeptide encoding for R11723_PEA_1_P7 (SEQ ID NO:1411), comprising a first amino acid sequence being at least 70%, optionally at least 80%, preferably at least 85%, more preferably at least 90% and most preferably at least 95% homologous to a polypeptide having the sequence MWVLG (SEQ ID NO: 1744) corresponding to amino acids 1-5 of R11723_PEA_1_P7 (SEQ ID NO:1411), second amino acid sequence being at least 90% homologous to IAATFCGLFLLPGFALQIQCYQ-CEEFQLNNDCSSPEFIVNCTVNVQDMC-QKEVMEQSAG corresponding to amino acids 22-80 of BAC85273, which also corresponds to amino acids 6-64 of R11723_PEA_1_P7 (SEQ ID NO:1411), and a third amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO:1743) corresponding to amino acids 65-93 of R11723_PEA_1_P7 (SEQ ID NO:1411), wherein said first, second and third amino acid sequences are contiguous and in a sequential order.

2. An isolated polypeptide encoding for ahead of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence MWVLG (SEQ ID NO:1744) of R11723_PEA_1_P7 (SEQ ID NO:1411).

3. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO:1743) in R11723_PEA_1_P7 (SEQ ID NO:1411).

Comparison report between R11723_PEA_1_P7 (SEQ ID NO:1411) and BAC85518 (SEQ ID NO:1710):

1. An isolated chimeric polypeptide encoding for R11723_PEA_1_P7 (SEQ ID NO:1411), comprising a first amino acid sequence being at least 90% homologous to MWVLGIAATFCGLFLLPGFALQIQCYQ-CEEFQLNNDCSSPEFIVNCTVNVQDMC-QKEVMEQSAG corresponding to amino acids 24-87 of BAC85518 (SEQ ID NO:1710), which also corresponds to amino acids 1-64 of R11723_PEA_1_P7 (SEQ ID NO:1411), and a second amino acid sequence being at least 70%, optionally at least 80%, preferably at least 85%, more preferably at least 90% and most preferably at least 95% homologous to a polypeptide having the sequence SHCVTR-LECSGTISAHCNLCLPGSNDHPT (SEQ ID NO: 1743) corresponding to amino acids 65-93 of R11723_PEA_1_P7 (SEQ ID NO:1411), wherein said first and second amino acid sequences are contiguous and in a sequential order.

2. An isolated polypeptide encoding for a tail of R11723_PEA_1_P7 (SEQ ID NO:1411), comprising a polypeptide being at least 70%, optionally at least about 80%, preferably at least about 85%, more preferably at least about 90% and most preferably at least about 95% homologous to the sequence SHCVTRLECSGTISAHCNLCLPGSNDHPT (SEQ ID NO: 1743) in R11723_PEA_1_P7 (SEQ ID NO:1411).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P7 (SEQ ID NO:1411) also has the following non-silent SNPs (Single Nucleotide Polymorphisms) as listed in Table 1247, (given according to their position(s) on the amino acid sequence, with the alternative amino acid(s) listed; the last column indicates whether the SNP is known or not; the presence of known SNPs in variant protein R11723_PEA_1_P7 (SEQ ID NO:1411) sequence provides support for the deduced sequence of this variant protein according to the present invention).

TABLE 1247

Amino acid mutations

| SNP position(s) on amino acid sequence | Alternative amino acid(s) | Previously known SNP? |
| --- | --- | --- |
| 67 | C -> S | Yes |

Variant protein R11723_PEA_1_P7 (SEQ ID NO:1411) is encoded by the following transcript(s): R11723_PEA_1_T17 (SEQ ID NO:145), for which the sequence(s) is/are given at the end of the application. The coding portion of transcript R11723_PEA_1_T17 (SEQ ID NO:145) is shown in bold; this coding portion starts at position 434 and ends at position 712. The transcript also has the following SNPs as listed in Table 1248 (given according to their position on the nucleotide sequence, with the alternative nucleic acid listed; the last column indicates whether the SNP is known or not; the presence of known SNPs in variant protein R11723_PEA_1_P7 (SEQ ID NO:1411) sequence provides support for the deduced sequence of this variant protein according to the present invention).

TABLE 1248

Nucleic acid SNPs

| SNP position on nucleotide sequence | Alternative nucleic acid | Previously known SNP? |
| --- | --- | --- |
| 625 | G -> T | Yes |
| 633 | G -> C | Yes |
| 1303 | C -> T | Yes |

Variant protein R11723_PEA_1_P13 (SEQ ID NO:1412) according to the present invention has an amino acid sequence as given at the end of the application; it is encoded by transcript(s) R11723_PEA_1_T19 (SEQ ID NO:146). One or more alignments to one or more previously published protein sequences are given at the end of the application. A brief description of the relationship of the variant protein according to the present invention to each such aligned protein is as follows:

Comparison report between R11723_PEA_1_P13 (SEQ ID NO:1412) and Q96AC2 (SEQ ID NO:1708):

1. An isolated chimeric polypeptide encoding for R11723_PEA_1_P13 (SEQ ID NO:1412), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q96AC2 (SEQ ID NO:1708), which also corresponds to amino acids 1-63 of R11723_PEA_1_P13 (SEQ ID NO:1412), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO: 1745) corresponding to amino acids 64-84 of R11723_PEA_1_P13 (SEQ ID NO:1412), wherein said first and second amino acid sequences are contiguous and in a sequential order.

2. An isolated polypeptide encoding for a tail of R11723_PEA_1_P13 (SEQ ID NO:1412), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO:1745) in R11723_PEA_1_P13 (SEQ ID NO:1412).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P13 (SEQ ID NO:1412) is encoded by the following transcript(s): R11723_PEA_1_T19 (SEQ ID NO:146) and R11723_PEA_1_T5 (SEQ ID NO:148), for which the sequence(s) is/are given at the end of the application. The coding portion of transcript R11723_PEA_1_T19 (SEQ ID NO:146) is shown in bold; this coding portion starts at position 434 and ends at position 685. The transcript also has the following SNPs as listed in Table 1249 (given according to their position on the nucleotide sequence, with the alternative nucleic acid listed; the last column indicates whether the SNP is known or not; the presence of known SNPs in variant protein R11723_PEA_1_P13 (SEQ ID NO:1412) sequence provides support for the deduced sequence of this variant protein according to the present invention).

TABLE 1249

| Nucleic acid SNPs | | |
| --- | --- | --- |
| SNP position on nucleotide sequence | Alternative nucleic acid | Previously known SNP? |
| 778 | G -> T | Yes |
| 786 | G -> C | Yes |
| 1456 | C -> T | Yes |

Variant protein R11723_PEA_1_P10 (SEQ ID NO:1413) according to the present invention has an amino acid sequence as given at the end of the application; it is encoded by transcript(s) R11723_PEA_1_T20 (SEQ ID NO:147). One or more alignments to one or more previously published protein sequences are given at the end of the application. A brief description of the relationship of the variant protein according to the present invention to each such aligned protein is as follows:

Comparison report between R11723_PEA_1_P10 (SEQ ID NO:1413) and Q96AC2 (SEQ ID NO:1708):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q96AC2 (SEQ ID NO:1708), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO:1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

Comparison report between R11723_PEA_1_P10 (SEQ ID NO:1413) and Q8N2G4 (SEQ ID NO:1709):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 1-63 of Q8N2G4 (SEQ ID NO:1709), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO:1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1746) in R11723_PEA_1_P10 (SEQ ID NO:1413).

Comparison report between R11723_PEA_1_P10 (SEQ ID NO:1413) and BAC85273:

1. An isolated chimeric polypeptide encoding for R11723_PEA_1_P10 (SEQ ID NO:1413), comprising a first amino acid sequence being at least 70%, optionally at least 80%, preferably at least 85%, more preferably at least 90% and most preferably at least 95% homologous to a polypeptide having the sequence MWVLG (SEQ ID NO: 1744) corresponding to amino acids 1-5 of R11723_PEA_1_P10 (SEQ ID NO:1413), second amino acid sequence being at least 90% homologous to IAATFCGLFLLPGFALQIQCYQ-CEEFQLNNDCSSPEFIVNCTVNVQDMCQKEVMEQSA corresponding to amino acids 22-79 of BAC85273, which also corresponds to amino acids 6-63 of R11723_PEA_1_P10 (SEQ ID NO:1413), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLPPRLK (SEQ ID NO: 1746) corresponding to amino acids 64-90 of R11723_PEA_1_P10 (SEQ ID NO:1413), wherein said first, second and third amino acid sequences are contiguous and in a sequential order.

2. An isolated polypeptide encoding for a head of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence MWVLG (SEQ ID NO: 1744) of R11723_PEA_1_P10 (SEQ ID NO:1413).

3. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO: 1746) in R11723_PEA_1_P10 (SEQ ID NO:1413).

Comparison report between R11723_PEA_1_P10 (SEQ ID NO:1413) and BAC85518 (SEQ ID NO:1710):

1. An isolated chimeric polypeptide encoding for R11723_PEA_1_P10 (SEQ ID NO:1413), comprising a first amino acid sequence being at least 90% homologous to MWVLGIAATFCGLFLLPGFALQIQCYQ-CEEFQLNNDCSSPEFIVNCTVNVQDMCQKEVMEQSA corresponding to amino acids 24-86 of BAC85518 (SEQ ID NO:1710), which also corresponds to amino acids 1-63 of R11723_PEA_1_P10 (SEQ ID NO:1413), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 1746) corresponding to amino acids 64-90 of R11723_PEA_1_P10 (SEQ ID NO:1413), wherein said first and second amino acid sequences are contiguous and in a sequential order.

2. An isolated polypeptide encoding for a tail of R11723_PEA_1_P10 (SEQ ID NO:1413), comprising a polypeptide being at least 70%, optionally at least about 80%, preferably at least about 85%, more preferably at least about 90% and most preferably at least about 95% homologous to the sequence DRVSLCHEAGVQWNNFSTLQPLPPRLK (SEQ ID NO:1746) in R11723_PEA_1_P10 (SEQ ID NO:1413).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P10 (SEQ ID NO:1413) also has the following non-silent SNPs (Single Nucleotide Polymorphisms) as listed in Table 1250, (given according to their position(s) on the amino acid sequence, with the alternative amino acid(s) listed; the last column indicates whether the SNP is known or not; the presence of known SNPs invariant protein R11723_PEA_1_P10 (SEQ ID NO:1413) sequence provides support for the deduced sequence of this variant protein according to the present invention).

TABLE 1250

Amino acid mutations

| SNP position(s) on amino acid sequence | Alternative amino acid(s) | Previously known SNP? |
|---|---|---|
| 66 | V -> F | Yes |

Variant protein R11723_PEA_1_P10 (SEQ ID NO:1413) is encoded by the following transcript(s): R11723_PEA_1_T20 (SEQ ID NO:147), for which the sequence(s) is/are given at the end of the application. The coding portion of transcript R11723_PEA_1_T20 (SEQ ID NO:147) is shown in bold; this coding portion starts at position 434 and ends at position 703. The transcript also has the following SNPs as listed in Table 1251 (given according to their position on the nucleotide sequence, with the alternative nucleic acid listed; the last column indicates whether the SNP is known or not; the presence of known SNPs in variant protein R11723_PEA_1_P10 (SEQ ID NO:1413) sequence provides support for the deduced sequence of this variant protein according to the present invention).

TABLE 1251

Nucleic acid SNPs

| SNP position on nucleotide sequence | Alternative nucleic acid | Previously known SNP? |
|---|---|---|
| 629 | G -> T | Yes |
| 637 | G -> C | Yes |
| 1307 | C -> T | Yes |

As noted above, cluster R11723 features 26 segment(s), which were listed in Table 1239 above and for which the sequence(s) are given at the end of the application. These segment(s) are portions of nucleic acid sequence(s) which are described herein separately because they are of particular interest. A description of each segment according to the present invention is now provided.

Segment cluster R11723_PEA_1_node_13 (SEQ ID NO:991) according to the present invention is supported by 5 libraries. The number of libraries was determined as previously described. This segment can be found in the following transcript(s): R11723_PEA_1_T19 (SEQ ID NO:146), R11723_PEA_1_T5 (SEQ ID NO:148) and R11723_PEA_1_T6 (SEQ ID NO:149). Table 1252 below describes the starting and ending position of this segment on each transcript.

TABLE 1252

Segment location on transcripts

| Transcript name | Segment starting position | Segment ending position |
|---|---|---|
| R11723_PEA_1_T19 (SEQ ID NO:146) | 624 | 776 |
| R11723_PEA_1_T5 (SEQ ID NO:148) | 624 | 776 |
| R11723_PEA_1_T6 (SEQ ID NO:149) | 658 | 810 |

Segment cluster R11723_PEA_1_node_16 (SEQ ID NO:992) according to the present invention is supported by 3 libraries. The number of libraries was determined as previously described. This segment can be found in the following transcript(s): R11723_PEA_1_T17 (SEQ ID NO:145), R11723_PEA_1_T19 (SEQ ID NO:146) and R11723_PEA_1_T20 (SEQ ID NO:147). Table 1253 below describes the starting and ending position of this segment on each transcript.

TABLE 1253

Segment location on transcripts

| Transcript name | Segment starting position | Segment ending position |
|---|---|---|
| R11723_PEA_1_T17 (SEQ ID NO:145) | 624 | 1367 |
| R11723_PEA_1_T19 (SEQ ID NO:146) | 777 | 1520 |
| R11723_PEA_1_T20 (SEQ ID NO:147) | 628 | 1371 |

Segment cluster R11723_PEA_1_node_19 (SEQ ID NO:993) according to the present invention is supported by 45 libraries. The number of libraries was determined as previously described. This segment can be found in the following transcript(s): R11723_PEA_1_T5 (SEQ ID NO:148) and R11723_PEA_1_T6 (SEQ ID NO:149). Table 1254 below describes the starting and ending position of this segment on each transcript.

TABLE 1254

Segment location on transcripts

| Transcript name | Segment starting position | Segment ending position |
|---|---|---|
| R11723_PEA_1_T5 (SEQ ID NO:148) | 835 | 1008 |
| R11723_PEA_1_T6 (SEQ ID NO:149) | 869 | 1042 |

Segment cluster R11723_PEA_1_node_2 (SEQ ID NO:994) according to the present invention is supported by 29 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1255 below describes the starting and ending position of this segment on each transcript.

TABLE 1255

Segment location on transcripts

| Transcript name | Segment starting position | Segment ending position |
|---|---|---|
| R11723_PEA_1_T15 (SEQ ID NO:144) | 1 | 309 |
| R11723_PEA_1_T17 (SEQ ID NO:145) | 1 | 309 |
| R11723_PEA_1_T19 (SEQ ID NO:146) | 1 | 309 |
| R11723_PEA_1_T20 (SEQ ID NO:147) | 1 | 309 |
| R11723_PEA_1_T5 (SEQ ID NO:148) | 1 | 309 |
| R11723_PEA_1_T6 (SEQ ID NO:149) | 1 | 309 |

Segment cluster R11723_PEA_1_node_22 (SEQ ID NO:995) according to the present invention is supported by 65 libraries. The number of libraries was determined as previously described. This segment can be found in the following transcript(s): R11723_PEA_1_T5 (SEQ ID NO:148) and R11723_PEA_1_T6 (SEQ ID NO:149). Table 1256 below describes the starting and ending position of this segment on each transcript.

TABLE 1256

Segment location on transcripts

| Transcript name | Segment starting position | Segment ending position |
|---|---|---|
| R11723_PEA_1_T5 (SEQ ID NO:148) | 1083 | 1569 |
| R11723_PEA_1_T6 (SEQ ID NO:149) | 1117 | 1603 |

Segment cluster R11723_PEA_1_node_31 (SEQ ID NO:996) according to the present invention is supported by 70 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1257 below describes the starting and ending position of this segment on each transcript (it should be noted that these transcripts show alternative polyadenylation).

TABLE 1257

Segment location on transcripts

| Transcript name | Segment starting position | Segment ending position |
|---|---|---|
| R11723_PEA_1_T15 (SEQ ID NO:144) | 1060 | 1295 |
| R11723_PEA_1_T5 (SEQ ID NO:148) | 1978 | 2213 |
| R11723_PEA_1_T6 (SEQ ID NO:149) | 2012 | 2247 |

According to an optional embodiment of the present invention, short segments related to the above cluster are also provided. These segments are up to about 120 bp in length, and so are included in a separate description.

Segment cluster R11723_PEA_1_node_10 (SEQ ID NO:997) according to the present invention is supported by 38 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1258 below describes the starting and ending position of this segment on each transcript.

TABLE 1258

Segment location on transcripts

| Transcript name | Segment starting position | Segment ending position |
|---|---|---|
| R11723_PEA_1_T15 (SEQ ID NO:144) | 486 | 529 |
| R11723_PEA_1_T17 (SEQ ID NO:145) | 486 | 529 |
| R11723_PEA_1_T19 (SEQ ID NO:146) | 486 | 529 |
| R11723_PEA_1_T20 (SEQ ID NO:147) | 486 | 529 |
| R11723_PEA_1_T5 (SEQ ID NO:148) | 486 | 529 |
| R11723_PEA_1_T6 (SEQ ID NO:149) | 520 | 563 |

Segment cluster R11723_PEA_1_node_11 (SEQ ID NO:998) according to the present invention is supported by 42 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1259 below describes the starting and ending position of this segment on each transcript.

TABLE 1259

Segment location on transcripts

| Transcript name | Segment starting position | Segment ending position |
|---|---|---|
| R11723_PEA_1_T15 (SEQ ID NO:144) | 530 | 623 |
| R11723_PEA_1_T17 (SEQ ID NO:145) | 530 | 623 |
| R11723_PEA_1_T19 (SEQ ID NO:146) | 530 | 623 |
| R11723_PEA_1_T20 (SEQ ID NO:147) | 530 | 623 |
| R11723_PEA_1_T5 (SEQ ID NO:148) | 530 | 623 |
| R11723_PEA_1_T6 (SEQ ID NO:149) | 564 | 657 |

Segment cluster R11723_PEA_1_node_15 (SEQ ID NO:999) according to the present invention can be found in the following transcript(s): R11723_PEA_1_T20 (SEQ ID NO:147). Table 1260 below describes the starting and ending position of this segment on each transcript.

TABLE 1260

Segment location on transcripts

| Transcript name | Segment starting position | Segment ending position |
|---|---|---|
| R11723_PEA_1_T20 (SEQ ID NO:147) | 624 | 627 |

Segment cluster R11723_PEA_1_node_18 (SEQ ID NO:1000) according to the present invention is supported by 40 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1261 below describes the starting and ending position of this segment on each transcript.

TABLE 1261

Segment location on transcripts

| Transcript name | Segment starting position | Segment ending position |
|---|---|---|
| R11723_PEA_1_T15 (SEQ ID NO:144) | 624 | 681 |
| R11723_PEA_1_T5 (SEQ ID NO:148) | 777 | 834 |
| R11723_PEA_1_T6 (SEQ ID NO:149) | 811 | 868 |

Segment cluster R11723_PEA_1_node_20 (SEQ ID NO:1001) according to the present invention can be found in the following transcript(s): R11723_PEA_1_T5 (SEQ ID NO:148) and R11723_PEA_1_T6 (SEQ ID NO:149). Table 1262 below describes the starting and ending position of this segment on each transcript.

TABLE 1262

Segment location on transcripts

| Transcript name | Segment starting position | Segment ending position |
|---|---|---|
| R11723_PEA_1_T5 (SEQ ID NO:148) | 1009 | 1019 |
| R11723_PEA_1_T6 (SEQ ID NO:149) | 1043 | 1053 |

Segment cluster R11723_PEA_1_node_21 (SEQ ID NO:1002) according to the present invention is supported by 36 libraries. The number of libraries was determined as previously described. This segment can be found in the following transcript(s): R11723_PEA_1_T5 (SEQ ID NO:148) and R11723_PEA_1_T6 (SEQ ID NO:149). Table 1263 below describes the starting and ending position of this segment on each transcript.

TABLE 1263

Segment location on transcripts

| Transcript name | Segment starting position | Segment ending position |
|---|---|---|
| R11723_PEA_1_T5 (SEQ ID NO:148) | 1020 | 1082 |
| R11723_PEA_1_T6 (SEQ ID NO:149) | 1054 | 1116 |

Segment cluster R11723_PEA_1_node_23 (SEQ ID NO:1003) according to the present invention is supported by 39 libraries. The number of libraries was determined as previously described. This segment can be found in the following transcript(s): R11723_PEA_1_T5 (SEQ ID NO:148) and R11723_PEA_1_T6 (SEQ ID NO:149). Table 1264 below describes the starting and ending position of this segment on each transcript.

TABLE 1264

Segment location on transcripts

| Transcript name | Segment starting position | Segment ending position |
|---|---|---|
| R11723_PEA_1_T5 (SEQ ID NO:148) | 1570 | 1599 |
| R11723_PEA_1_T6 (SEQ ID NO:149) | 1604 | 1633 |

Segment cluster R11723_PEA_1_node_24 (SEQ ID NO:1004) according to the present invention is supported by 51 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1265 below describes the starting and ending position of this segment on each transcript.

TABLE 1265

Segment location on transcripts

| Transcript name | Segment starting position | Segment ending position |
|---|---|---|
| R11723_PEA_1_T15 (SEQ ID NO:144) | 682 | 765 |
| R11723_PEA_1_T5 (SEQ ID NO:148) | 1600 | 1683 |
| R11723_PEA_1_T6 (SEQ ID NO:149) | 1634 | 1717 |

Segment cluster R11723_PEA_1_node_25 (SEQ ID NO:1005) according to the present invention is supported by 54 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1266 below describes the starting and ending position of this segment on each transcript.

TABLE 1266

Segment location on transcripts

| Transcript name | Segment starting position | Segment ending position |
|---|---|---|
| R11723_PEA_1_T15 (SEQ ID NO:144) | 766 | 791 |
| R11723_PEA_1_T5 (SEQ ID NO:148) | 1684 | 1709 |
| R11723_PEA_1_T6 (SEQ ID NO:149) | 1718 | 1743 |

Segment cluster R11723_PEA_1_node_26 (SEQ ID NO:1006) according to the present invention is supported by 62 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1267 below describes the starting and ending position of this segment on each transcript.

TABLE 1267

Segment location on transcripts

| Transcript name | Segment starting position | Segment ending position |
|---|---|---|
| R11723_PEA_1_T15 (SEQ ID NO:144) | 792 | 904 |
| R11723_PEA_1_T5 (SEQ ID NO:148) | 1710 | 1822 |
| R11723_PEA_1_T6 (SEQ ID NO:149) | 1744 | 1856 |

Segment cluster R11723_PEA_1_node_27 (SEQ ID NO:1007) according to the present invention is supported by 67 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1268 below describes the starting and ending position of this segment on each transcript.

TABLE 1268

Segment location on transcripts

| Transcript name | Segment starting position | Segment ending position |
|---|---|---|
| R11723_PEA_1_T15 (SEQ ID NO:144) | 905 | 986 |
| R11723_PEA_1_T5 (SEQ ID NO:148) | 1823 | 1904 |
| R11723_PEA_1_T6 (SEQ ID NO:149) | 1857 | 1938 |

Segment cluster R11723_PEA_1_node_28 (SEQ ID NO:1008) according to the present invention can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1269 below describes the starting and ending position of this segment on each transcript.

TABLE 1269

Segment location on transcripts

| Transcript name | Segment starting position | Segment ending position |
|---|---|---|
| R11723_PEA_1_T15 (SEQ ID NO:144) | 987 | 1010 |
| R11723_PEA_1_T5 (SEQ ID NO:148) | 1905 | 1928 |
| R11723_PEA_1_T6 (SEQ ID NO:149) | 1939 | 1962 |

Segment cluster R11723_PEA_1_node_29 (SEQ ID NO:1009) according to the present invention is supported by 69 libraries. The number of libraries was determined as previously described. This segment can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1270 below describes the starting and ending position of this segment on each transcript.

TABLE 1270

Segment location on transcripts

| Transcript name | Segment starting position | Segment ending position |
|---|---|---|
| R11723_PEA_1_T15 (SEQ ID NO:144) | 1011 | 1038 |
| R11723_PEA_1_T5 (SEQ ID NO:148) | 1929 | 1956 |
| R11723_PEA_1_T6 (SEQ ID NO:149) | 1963 | 1990 |

Segment cluster R11723_PEA_1_node_3 (SEQ ID NO:1010) according to the present invention can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1271 below describes the starting and ending position of this segment on each transcript.

TABLE 1271

Segment location on transcripts

| Transcript name | Segment starting position | Segment ending position |
|---|---|---|
| R11723_PEA_1_T15 (SEQ ID NO:144) | 310 | 319 |
| R11723_PEA_1_T17 (SEQ ID NO:145) | 310 | 319 |
| R11723_PEA_1_T19 (SEQ ID NO:146) | 310 | 319 |
| R11723_PEA_1_T20 (SEQ ID NO:147) | 310 | 319 |
| R11723_PEA_1_T5 (SEQ ID NO:148) | 310 | 319 |
| R11723_PEA_1_T6 (SEQ ID NO:149) | 310 | 319 |

Segment cluster R11723_PEA_1_node_30 (SEQ ID NO:1011) according to the present invention can be found in the following transcript(s): R11723_PEA_1_T15 (SEQ ID NO:144), R11723_PEA_1_T5 (SEQ ID NO:148) and R11723_PEA_1_T6 (SEQ ID NO:149). Table 1272 below describes the starting and ending position of this segment on each transcript.

TABLE 1272

Segment location on transcripts

| Transcript name | Segment starting position | Segment ending position |
|---|---|---|
| R11723_PEA_1_T15 (SEQ ID NO:144) | 1039 | 1059 |
| R11723_PEA_1_T5 (SEQ ID NO:148) | 1957 | 1977 |
| R11723_PEA_1_T6 (SEQ ID NO:149) | 1991 | 2011 |

Segment cluster R11723_PEA_1_node_4 (SEQ ID NO:1012) according to the present invention is supported by 25 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1273 below describes the starting and ending position of this segment on each transcript.

TABLE 1273

Segment location on transcripts

| Transcript name | Segment starting position | Segment ending position |
|---|---|---|
| R11723_PEA_1_T15 (SEQ ID NO:144) | 320 | 371 |
| R11723_PEA_1_T17 (SEQ ID NO:145) | 320 | 371 |
| R11723_PEA_1_T19 (SEQ ID NO:146) | 320 | 371 |
| R11723_PEA_1_T20 (SEQ ID NO:147) | 320 | 371 |
| R11723_PEA_1_T5 (SEQ ID NO:148) | 320 | 371 |
| R11723_PEA_1_T6 (SEQ ID NO:149) | 320 | 371 |

Segment cluster R11723_PEA_1_node_5 (SEQ ID NO:1013) according to the present invention is supported by 26 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1274 below describes the starting and ending position of this segment on each transcript.

TABLE 1274

Segment location on transcripts

| Transcript name | Segment starting position | Segment ending position |
|---|---|---|
| R11723_PEA_1_T15 (SEQ ID NO:144) | 372 | 414 |
| R11723_PEA_1_T17 (SEQ ID NO:145) | 372 | 414 |
| R11723_PEA_1_T19 (SEQ ID NO:146) | 372 | 414 |
| R11723_PEA_1_T20 (SEQ ID NO:147) | 372 | 414 |
| R11723_PEA_1_T5 (SEQ ID NO:148) | 372 | 414 |
| R11723_PEA_1_T6 (SEQ ID NO:149) | 372 | 414 |

Segment cluster R11723_PEA_1_node_6 (SEQ ID NO:1014) according to the present invention is supported by 27 libraries. The number of libraries was determined as previously described. This segment can be found in the following transcript(s): R11723_PEA_1_T15 (SEQ ID NO:144), R11723_PEA_1_T17 (SEQ ID NO:145), R11723_PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1275 below describes the starting and ending position of this segment on each transcript.

TABLE 1275

Segment location on transcripts

| Transcript name | Segment starting position | Segment ending position |
|---|---|---|
| R11723_PEA_1_T15 (SEQ ID NO:144) | 415 | 446 |
| R11723_PEA_1_T17 (SEQ ID NO:145) | 415 | 446 |
| R11723_PEA_1_T19 (SEQ ID NO:146) | 415 | 446 |
| R11723_PEA_1_T20 (SEQ ID NO:147) | 415 | 446 |
| R11723_PEA_1_T5 (SEQ ID NO:148) | 415 | 446 |
| R11723_PEA_1_T6 (SEQ ID NO:149) | 415 | 446 |

Segment cluster R11723_PEA_1_node_7 (SEQ ID NO:1015) according to the present invention is supported by 29 libraries. The number of libraries was determined as previously described. This segment can be found in the following transcript(s): R11723_PEA_1_T5 (SEQ ID NO:144), R11723_PEA_1_T17 (SEQ ID NO:145), R11723PEA_1_T19 (SEQ ID NO:146), R11723_PEA_1_T20 (SEQ ID NO:147), R11723_PEA_1_T5 (SEQ ID NO:148) and R11723_PEA_1_T6 (SEQ ID NO:149). Table 1276 below describes the starting and ending position of this segment on each transcript.

TABLE 1276

Segment location on transcripts

| Transcript name | Segment starting position | Segment ending position |
|---|---|---|
| R11723_PEA_1_T15 (SEQ ID NO:144) | 447 | 485 |
| R11723_PEA_1_T17 (SEQ ID NO:145) | 447 | 485 |
| R11723_PEA_1_T19 (SEQ ID NO:146) | 447 | 485 |
| R11723_PEA_1_T20 (SEQ ID NO:147) | 447 | 485 |
| R11723_PEA_1_T5 (SEQ ID NO:148) | 447 | 485 |
| R11723_PEA_1_T6 (SEQ ID NO:149) | 447 | 485 |

Segment cluster R11723_PEA_1_node_8 (SEQ ID NO:1016) according to the present invention is supported by 2 libraries. The number of libraries was determined as previously described. This segment can be found in the following transcript(s): R11723_PEA_1_T6 (SEQ ID NO:149). Table 1277 below describes the starting and ending position of this segment on each transcript.

TABLE 1277

Segment location on transcripts

| Transcript name | Segment starting position | Segment ending position |
|---|---|---|
| R11723_PEA_1_T6 (SEQ ID NO:149) | 486 | 519 |

Variant protein alignment to the previously known protein:

Sequence name: /tmp/gp6eQTLWqk/mFtjUpUzhb: Q81XM0 (SEQ ID NO:1707)

Sequence documentation:

Alignment of: R11723_PEA__1_P6 (SEQ ID NO:1410) x Q81XMO (SEQ ID NO:1707)

Alignment segment 1/1:

| | |
|---|---|
| Quality: 1128.00 | Escore: 0 |
| Matching length: 112 | Total length: 112 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
111   MYAQALLVVGVLQRQAAAQHLHEHPPKLLRGHTVQERVDDRAEVEKRLRE   160
      ||||||||||||||||||||||||||||||||||||||||||||||||||
  1   MYAQALLVVGVLQRQAAAQHLHEHPPKLLRGHTVQERVDDRAEVEKRLRE    50

161   GEEDHVRPEVGPRPVVLGFGRSHDPPNLVGHPAYGQCHNNQPWADTSRRE   210
      ||||||||||||||||||||||||||||||||||||||||||||||||||
 51   GEEDHVRPEVGPRPVVLGFGRSHDPPNLVGHPAYGQCHNNQPWADTSRRE   100

211   RQRKEKHSMRTQ                                        222
      ||||||||||||
101   RQRKEKHSMRTQ                                        112
```

Sequence name: /tmp/gp6eQTLWqk/mFtjUpUzhb:Q96AC2 (SEQ ID NO:1708)

Sequence documentation:

Alignment of: R11723_PEA__1_P6 (SEQ ID NO:1410) x Q96AC2 (SEQ ID NO:1708)

Alignment segment 1/1:

| | |
|---|---|
| Quality: 835.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1   MWVLGIAATFCGLFLLPGFALQIQCYQCEEFQLNNDCSSPEFIVNCTVNV    50
      ||||||||||||||||||||||||||||||||||||||||||||||||||
  1   MWVLGIAATFCGLFLLPGFALQIQCYQCEEFQLNNDCSSPEFIVNCTVNV    50

51   QDMCQKEVMEQSAGIMYRKSCASSAACLIASAG                    83
      |||||||||||||||||||||||||||||||||
 51   QDMCQKEVMEQSAGIMYRKSCASSAACLIASAG                    83
```

Sequence name: /tmp/gp6eQTLWqk/mFtjUpUzhb:Q8N2G4 (SEQ ID NO:1709)
Sequence documentation:
Alignment of: R11723_PEA__1_P6 (SEQ ID NO:1410) x Q8N2G4 (SEQ ID NO:1709)

Alignment segment 1/1:

| | |
|---|---|
| Quality: 835.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAGIMYRKSCASSAACLIASAG  83
    |||||||||||||||||||||||||||||||||
51  QDMCQKEVMEQSAGIMYRKSCASSAACLIASAG  83
```

Sequence name: /tmp/gp6eQTLWqk/mFtjUpUzhb:BAC85518 (SEQ ID NO:1710)

Sequence documentation:

Alignment of: R11723_PEA_1_P6 (SEQ ID NO:1410) x BAC85518 (SEQ ID NO:1710)

Alignment segment 1/1:

| | |
|---|---|
| Quality: 835.00 | Escore: 0 |
| Matching length: 83 | Total length: 83 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSAGIMYRKSCASSAACLIASAG   83
    |||||||||||||||||||||||||||||||||
74  QDMCQKEVMEQSAGIMYRKSCASSAACLIASAG  106
```

Sequence name: /tmp/VXjdFlzdBX/bexTxTh0Th:Q96AC2 (SEQ ID NO:1708)

Sequence documentation:

Alignment of: R11723_PEA_1_P7 (SEQ ID NO:1411) x Q96AC2 (SEQ ID NO:1708)

Alignment segment 1/1:

| | |
|---|---|
| Quality: 654.00 | Escore: 0 |
| Matching length: 64 | Total length: 64 |
| Matching Percent Similarity: 100.00 | Matching Percent Identity: 100.00 |
| Total Percent Similarity: 100.00 | Total Percent Identity: 100.00 |
| Gaps: 0 | |

Sequence name: /tmp/VXjdFlzdBX/bexTxTh0Th:Q8N2G4 (SEQ ID NO:1709)

Sequence documentation:

Alignment of: R11723_PEA_1_P7 (SEQ ID NO:1411) x Q8N2G4 (SEQ ID NO:1709)

Alignment segment 1/1:

| | |
|---|---|
| Quality: 654.00 | Escore: 0 |
| Matching length: 64 | Total length: 64 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSAG  64
    ||||||||||||||
51  QDMCQKEVMEQSAG  64
```

Sequence name: /tmp/VXjdFlzdBX/bexTxTh0Th: BAC85273

Sequence documentation:

Alignment of: R11723_PEA_1_P7 (SEQ ID NO:1411) x BAC85273 . . .

Alignment segment 1/1:

| Quality: 600.00 | Escore: 0 |
|---|---|
| Matching length: 59 | Total length: 59 |
| Matching Percent Similarity: 100.00 | Matching Percent Identity: 100.00 |
| Total Percent Similarity: 100.00 | Total Percent Identity: 100.00 |
| Gaps: 0 | |

Sequence name: /tmp/OLMSexEmIh/pc7Z7Xm1YR: Q96AC2 (SEQ ID NO:1708)

Sequence documentation:

Alignment of: R11723_PEA_1_P10 (SEQ ID NO:1413) x Q96AC2 (SEQ ID NO:1708)

Alignment segment 1/1:

| Quality: 645.00 | Escore: 0 |
|---|---|
| Matching length: 63 | Total length: 63 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 6  IAATFCGLFLLPGFALQIQCYQCEEFQLNNDCSSPEFIVNCTVNVQDMCQ  55
    |||||||||||||||||||||||||||||||||||||||||||||||||
22  IAATFCGLFLLPGFALQIQCYQCEEFQLNNDCSSPEFIVNCTVNVQDMCQ  71

56  KEVMEQSAG  64
    |||||||||
72  KEVMEQSAG  80
```

Sequence name: /tmp/VXjdFlzdBX/bexTxTh0Th: BAC85518 (SEQ ID NO:1710)

Sequence documentation:

Alignment of: R11723_PEA_1_P7 (SEQ ID NO:1411) x BAC85518 (SEQ ID NO:1710)

Alignment segment 1/1:

| Quality: 654.00 | Escore: 0 |
|---|---|
| Matching length: 64 | Total length: 64 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
24  MWVLGIAATFCGLFLLPGFALQIQCYQCEEFQLNNDCSSPEFIVNCTVNV  73

51  QDMCQKEVMEQSAG  64
    ||||||||||||||
74  QDMCQKEVMEQSAG  87
```

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSA  63
    |||||||||||||
51  QDMCQKEVMEQSA  63
```

Sequence name: /tmp/OLMSexEmIh/pc7Z7Xm1YR: Q8N2G4 (SEQ ID NO:1709)

Sequence documentation:

Alignment of: R11723_PEA__1_P10 (SEQ ID NO:1413) x Q8N2G4 (SEQ ID NO:1709)

Alignment segment 1/1:

| | |
|---|---|
| Quality: 645.00 | Escore: 0 |
| Matching length: 63 | Total length: 63 |
| Matching Percent Similarity: 100.00 | Matching Percent Identity: 100.00 |
| Total Percent Similarity: 100.00 | Total Percent Identity: 100.00 |
| Gaps: 0 | |

Sequence name: /tmp/OLMSexEmIh/pc7Z7Xm1YR: BAC85518 (SEQ ID NO:1710)

Sequence documentation:

Alignment of: R11723_PEA__1_P10 (SEQ ID NO:1413) x BAC85518 (SEQ ID NO:1710)

Alignment segment 1/1:

| | |
|---|---|
| Quality: 645.00 | Escore: 0 |
| Matching length: 63 | Total length: 63 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    |||||||||||||||||||||||||||||||||||||||||||||||||
 1  MWVLGIAATFCGLFLLPGFALQIQCYQCEEFQLNNDCSSPEFIVNCTVNV  50

51  QDMCQKEVMEQSA  63
    |||||||||||||
51  QDMCQKEVMEQSA  63
```

Sequence name: /tmp/OLMSexEmIh/pc7Z7Xm1YR: BAC85273

Sequence documentation:

Alignment of: R11723_PEA__1_P10 (SEQ ID NO:1413) x BAC85273 . . .

Alignment segment 1/1:

| | |
|---|---|
| Quality: 591.00 | Escore: 0 |
| Matching length: 58 | Total length: 58 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 6  IAATFCGLFLLPGFALQIQCYQCEEFQLNNDCSSPEFIVNCTVNVQDMCQ  55
    |||||||||||||||||||||||||||||||||||||||||||||||||
22  IAATFCGLFLLPGFALQIQCYQCEEFQLNNDCSSPEFIVNCTVNVQDMCQ  71

56  KEVMEQSA  63
    ||||||||
72  KEVMEQSA  79
```

Alignment:

```
 1  MWVLGIAATFCGLFLLPGFALQIQCYQCEEFQLNNDCSSPEFIVNCTVNV  50
    ||||||||||||||||||||||||||||||||||||||||||||||||||
24  MWVLGIAATFCGLFLLPGFALQIQCYQCEEFQLNNDCSSPEFIVNCTVNV  73

51  QDMCQKWVMEQSA                                       63
    |||||||||||||
74  QDMCQKWVMEQSA                                       86
```

Alignment of: R11723_PEA_1_P13 (SEQ ID NO:1412) x Q96AC2 (SEQ ID NO:1708)

Alignment segment 1/1:

| | |
|---|---|
| Quality: 645.00 | Escore: 0 |
| Matching length: 63 | Total length: 63 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
 1  MWVLGIAATFCGLFLLPGFALQIQCYQCEEFQLNNDCSSPEFIVNCTVNV  50
    ||||||||||||||||||||||||||||||||||||||||||||||||||
 1  MWVLGIAATFCGLFLLPGFALQIQCYQCEEFQLNNDCSSPEFIVNCTVNV  50

51  QDMCQKWVMEQSA                                       63
    |||||||||||||
51  QDMCQKWVMEQSA                                       63
```

It should be noted that the nucleotide transcript sequence of known protein (PSEC, also referred to herein as the "wild type" or WT protein) feature at least one SNP that appears to affect the coding region, in addition to certain silent SNPs. This SNP does not have an effect on the R11723_PEA_1_T5 (SEQ ID NO:148) splice variant sequence): "G→" resulting in a missing nucleotide (affects amino acids from position 91 onwards). The missing nucleotide creates a frame shift, resulting in a new protein. This SNP was not previously identified and is supported by 5 ESTs out of ~70 ESTs in this exon.

It should be noted that the variants of this cluster are variants of the hypothetical protein PSEC0181 (referred to herein as "PSEC"). Furthermore, use of the known protein (WT protein) for detection of lung cancer, alone or in combination with one or more variants of this cluster and/or of any other cluster and/or of any known marker, also comprises an embodiment of the present invention.

Expression of R11723 Transcripts which are Detectable by Amplicon as Depicted in Sequence Name R11723 seg13 (SEQ ID NO:1684) in Normal and Cancerous Lung Tissues Expression of transcripts detectable by or according to R11723 seg13, R11723 seg13 amplicon (SEQ ID NO: 1684), and R11723 seg13F (SEQ ID NO:1682), and R11723 seg13R (SEQ ID NO:1683), primers was measured by real time PCR. In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), and SDHA (GenBank Accession No. NM_004168 (SEQ ID NO:1712); amplicon—SDHA-amplicon, SEQ ID NO:331), Ubiquitin (GenBank Accession No. BC000449 (SEQ ID NO:1711); amplicon—Ubiquitin-amplicon, SEQ ID NO:328) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2 "Tissue samples in testing panel", above), to obtain a value of fold up-regulation for each sample relative to median of the normal PM samples.

Figure 48:
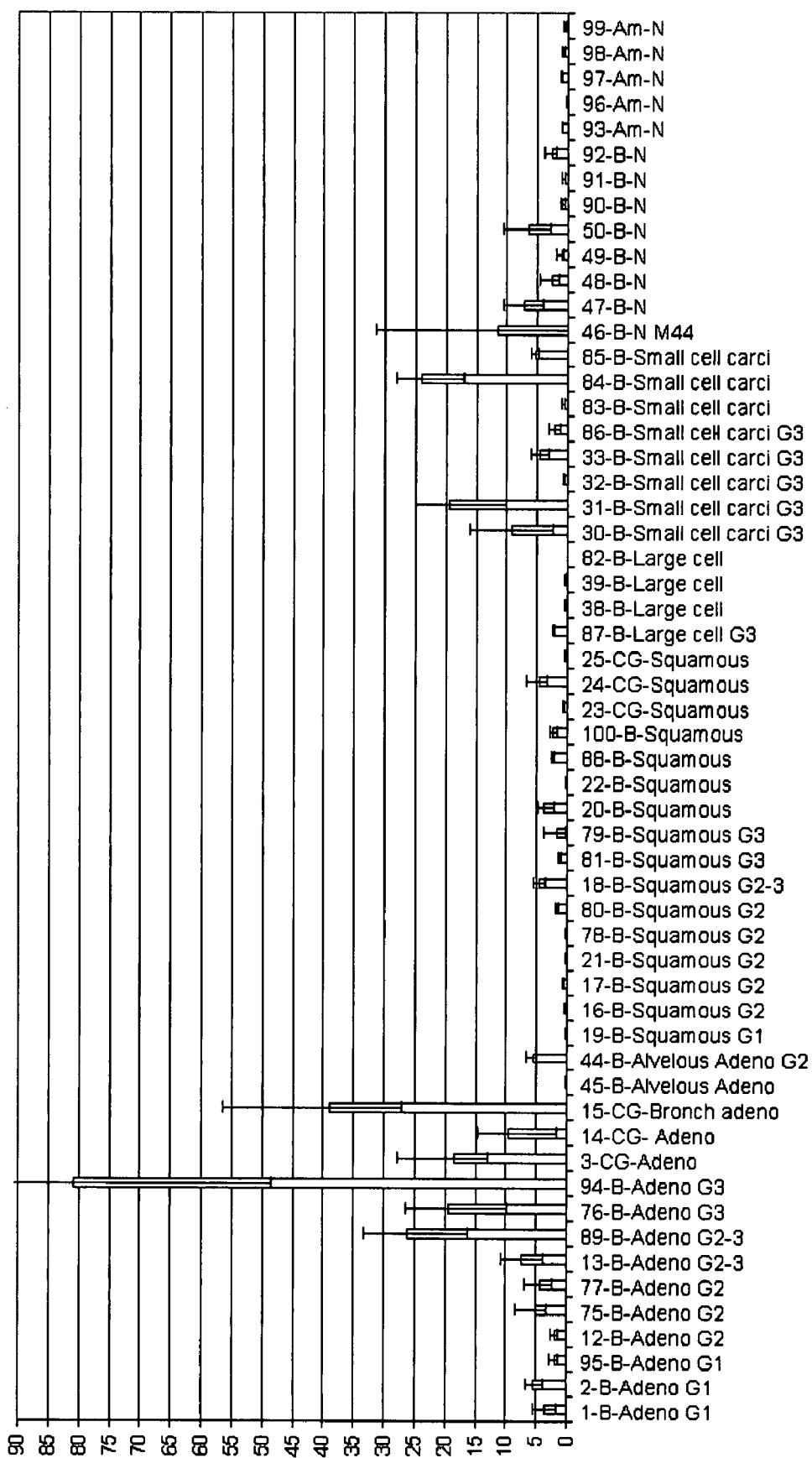
FIG. 48 is a histogram showing over expression of the R11723 transcripts, which are detectable by amplicon as depicted in sequence name R11723 seg13 (SEQ ID NO:1684), in cancerous lung samples relative to the normal samples.

FIG. 48 is a histogram showing over expression of the above-indicated transcripts in cancerous lung samples relative to the normal samples. The number and percentage of samples that exhibit at least 5 fold over-expression, out of the total number of samples tested is indicated in the bottom.

As is evident from FIG. 48, the expression of transcripts detectable by the above amplicon(s) in cancer samples was higher than in the non-cancerous samples (Sample Nos. 47-50, 90-93, 96-99 Table 2 "Tissue samples in testing panel"). Notably an over-expression of at least 5 fold was found in 10 out of 15 adenocarcinoma samples, and in 4 out of 8 small cells carcinoma samples.

Primer pairs are also optionally and preferably encompassed within the present invention; for example, for the above experiment, the following primer pair was used as a non-limiting illustrative example only of a suitable primer pair: R11723 seg13F forward primer (SEQ ID NO:1682); and R11723 seg13R reverse primer (SEQ ID NO: 1683).

The present invention also preferably encompasses any amplicon obtained through the use of any suitable primer pair; for example, for the above experiment, the following amplicon was obtained as a non-limiting illustrative example only of a suitable amplicon: R11723 seg13 (SEQ ID NO:1684).

R11723seg13F (SEQ ID NO:1682),—ACACTAAAA-GAACAAACACCTTGCTC

R11723seg13R (SEQ ID NO:1683),—TCCTCAGAAG-GCACATGAAAGA

R11723seg13—amplicon (SEQ ID NO:1684),: ACAC-TAAAAGAACAAACACCTTGCTCTTCGAGATGAGA-CATTTTGCCAAGCAGTTGACCACT TAGTTCTCAA-GAAGCAACTATCTCTTTCATGTGCCTTCTGAGGA Expression of R11723 Transcripts which are Detectable by Amplicon as Depicted in Sequence Name R11723seg13 (SEQ ID NO:1684) in Different Normal Tissues Expression of R11723 transcripts detectable by or according to R11723seg13 amplicon (SEQ ID NO: 1684), and R11723seg13F (SEQ ID NO:1682), R11723seg13R (SEQ ID NO:1683), was measured by real time PCR. In parallel the expression of four housekeeping genes RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20, Table 2 "Tissue samples in normal panel" above), to obtain a value of relative expression of each sample relative to median of the ovary samples.

R11723seg13F (SEQ ID NO:1682),—ACACTAAAA-GAACAAACACCTTGCTC

R11723seg13R (SEQ ID NO:1683),—TCCTCAGAAG-GCACATGAAAGA

Figure 49:
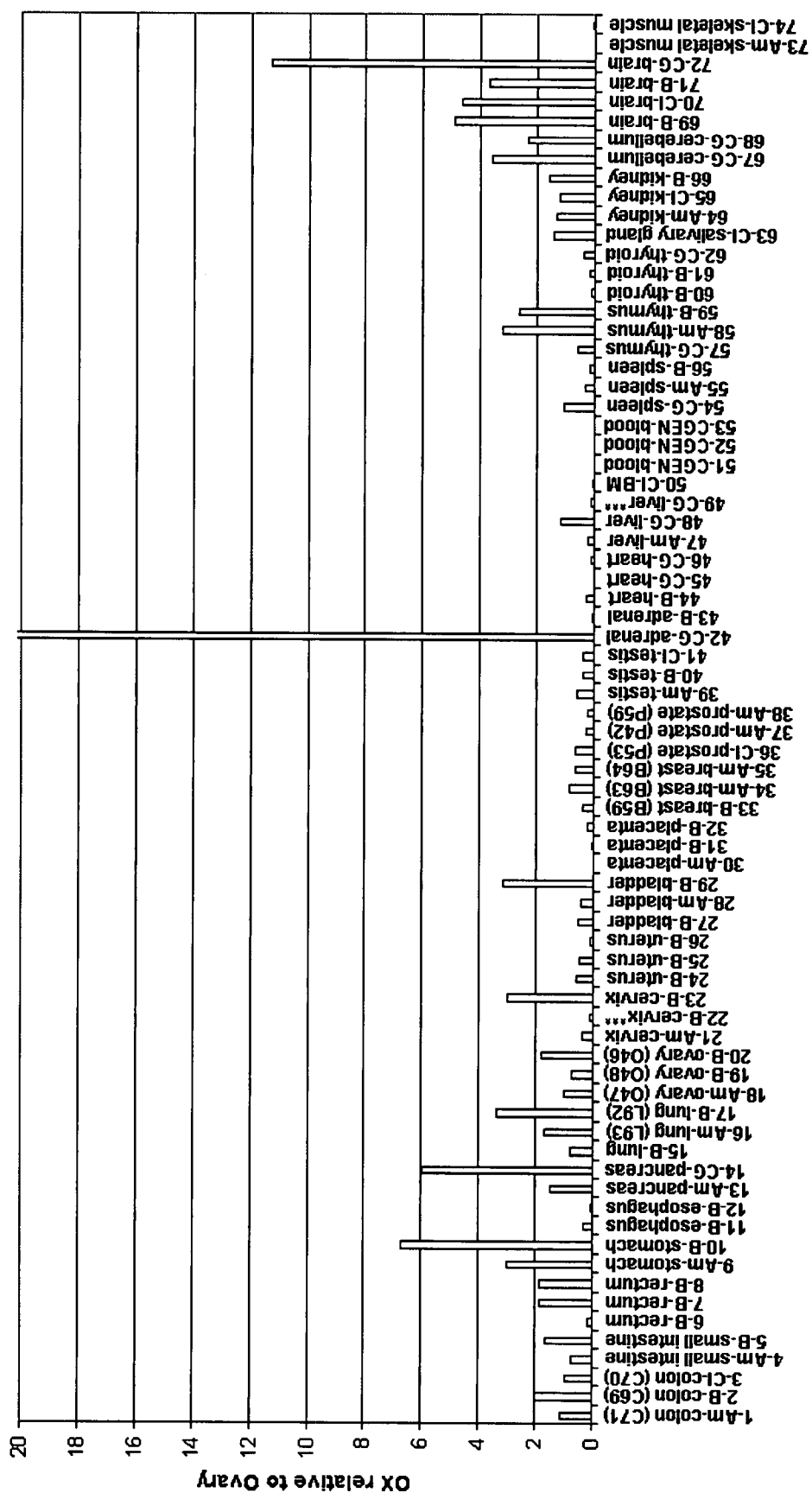
FIG. 49 is a histogram showing the expression of R11723 transcripts which are detectable by amplicon as depicted in sequence name R11723seg13 (SEQ ID NO:1684) in different normal tissues.

R11723seg13—amplicon (SEQ ID NO:1684),: ACAC-TAAAAGAACAAACACCTTGCTCTTCGAGATGAG-ACATTTTGCCAAGCAGTTGACCACTTAGTTC TCAA-GAAGCAACTATCTCTTTCATGTGCCTTCTGAGGA The results are presented in FIG. 49, showing the expression of R11723 transcripts which are detectable by amplicon as depicted in sequence name R11723seg13 (SEQ ID NO:1684) in different normal tissues.

Expression of R11723 Transcripts, which are Detectable by Amplicon as Depicted in Sequence Name R11723junc11-18 (SEQ ID NO:1687) in Normal and Cancerous Lung Tissues Expression of transcripts detectable by or according to junc11-18, R11723 junc11-18 amplicon (SEQ ID NO: 1687) and R11723 junc11-18F (SEQ ID NO:1685) and R11723 junc11-18R (SEQ ID NO: 1686) primers was measured by real time PCR (this junction is found in the known protein sequence or "wild type" (WT) sequence, also termed herein the PSEC sequence). In parallel the expression of four housekeeping genes PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), SDHA (GenBank Accession No. NM_004168 (SEQ ID NO:1712); amplicon—SDHA-amplicon, SEQ ID NO:331), and Ubiquitin (GenBank Accession No. BC000449 (SEQ ID NO:1711); amplicon—Ubiquitin-amplicon, SEQ ID NO:328) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above: "Tissue samples in lung cancer testing panel"), to obtain a value of fold up-regulation for each sample relative to median of the normal PM samples.

Figure 50:
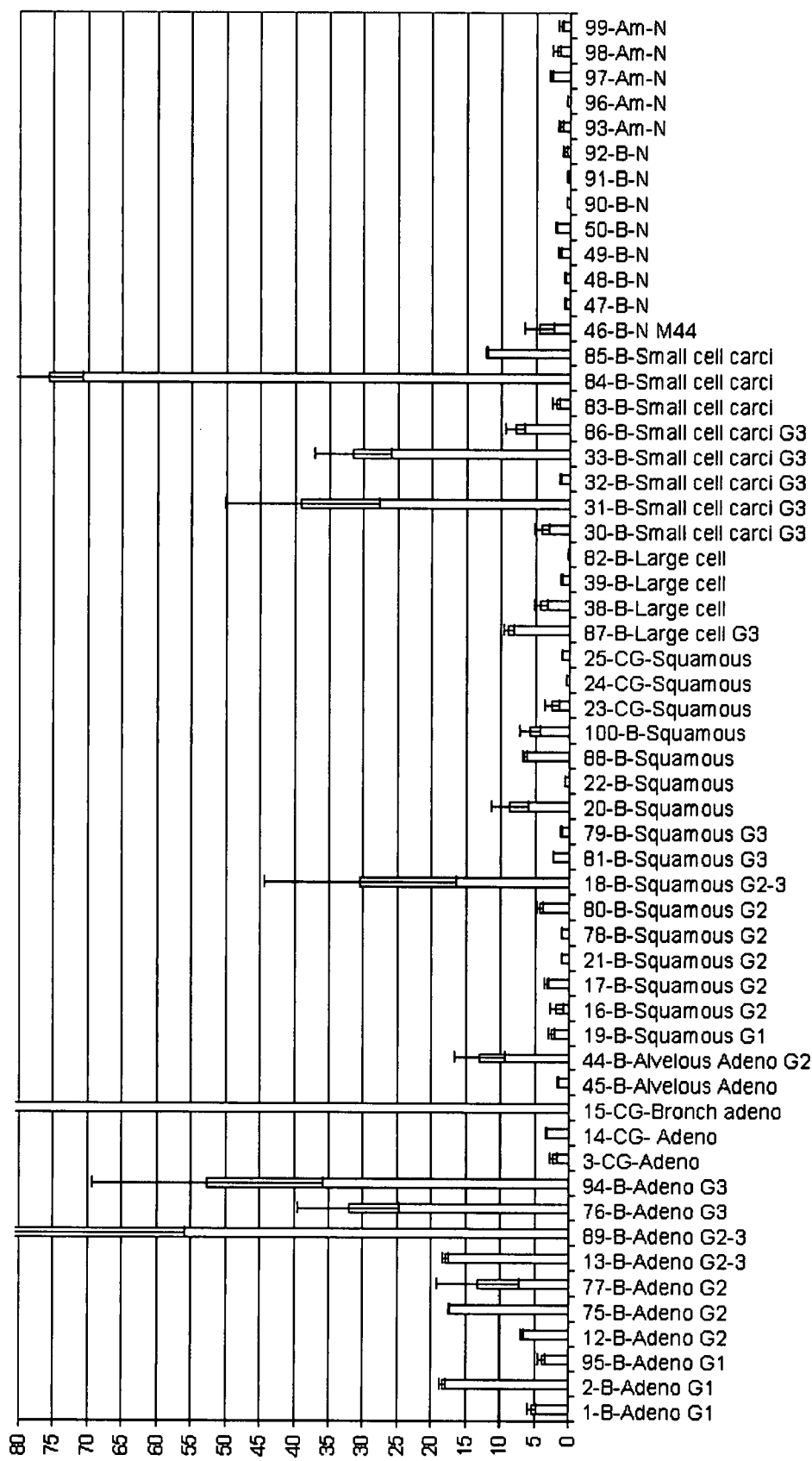
FIG. 50 is a histogram showing over expression of the R11723 transcripts, which are detectable by amplicon as depicted in sequence name R11723 junc11-18 (SEQ ID NO:1687) in cancerous lung samples relative to the normal samples.

FIG. 50 is a histogram showing over expression of the above-indicated transcripts in cancerous lung samples relative to the normal samples. Values represent the average of duplicate experiments. Error bars indicate the minimal and maximal values obtained.

As is evident from FIG. 50, the expression of transcripts detectable by the above amplicon in cancer samples was higher than in the non-cancerous samples (Sample Nos. 47-50, 90-93, 96-99 Table 2 "Tissue samples in lung cancer testing panel"). Notably an over-expression of at least 5 fold was found in 11 out of 15 adenocarcinoma samples, 4 out of 16 squamous cell carcinoma samples, 1 out of 4 large cell carcinoma samples and in 5 out of 8 small cells carcinoma samples.

Primer pairs are also optionally and preferably encompassed within the present invention; for example, for the above experiment, the following primer pair was used as a non-limiting illustrative example only of a suitable primer pair: R11723 junc11-18F forward primer (SEQ ID NO: 1685); and R11723 junc11-18R reverse primer (SEQ ID NO:1686).

The present invention also preferably encompasses any amplicon obtained through the use of any suitable primer pair; for example, for the above experiment, the following amplicon was obtained as a non-limiting illustrative example only of a suitable amplicon: R11723 junc11-18 (SEQ ID NO:1687).

R11723junc11-18F (SEQ ID NO:1685)—AGTGATGGAG-CAAAGTGCCG

R11723 junc11-18R (SEQ ID NO:1686)—CAGCAGCT-GATGCAAACTGAG

R11723 junc11-18—amplicon (SEQ ID NO: 1687) AGT-GATGGAGCAAAGTGCCGGGATCATGTACCGCAAGT-CCTGTGCATCATCAGCGGCCTGTCTCATCG CCTCT-GCCGGGTACCAGTCCTTCTGCTCCCAGGGAAAC-TGAACTCAGTTTTGCATCAGCTGCTG Expression of R11723 Transcripts, which were Detected by Amplicon as Depicted in the Sequence Name R11723 junc11-18 (SEQ ID NO:1687) in Different Normal Tissues Expression of R11723 transcripts detectable by or according to R11723seg13 amplicon (SEQ ID NO:1687) and R11723junc11-18F (SEQ ID NO:1685), R11723junc11-18R (SEQ ID NO:1686) was measured by real time PCR. In parallel the expression of four housekeeping genes RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No.

BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the ovary samples (Sample Nos. 18-20 Table 3 above), to obtain a value of relative expression of each sample relative to median of the ovary samples.

R11723junc1-18F (SEQ ID NO:1685)—AGTGATGGAG-CAAAGTGCCG

R11723 junc11-18R (SEQ ID NO:1686)—CAGCAGCT-GATGCAAACTGAG

Figure 73:
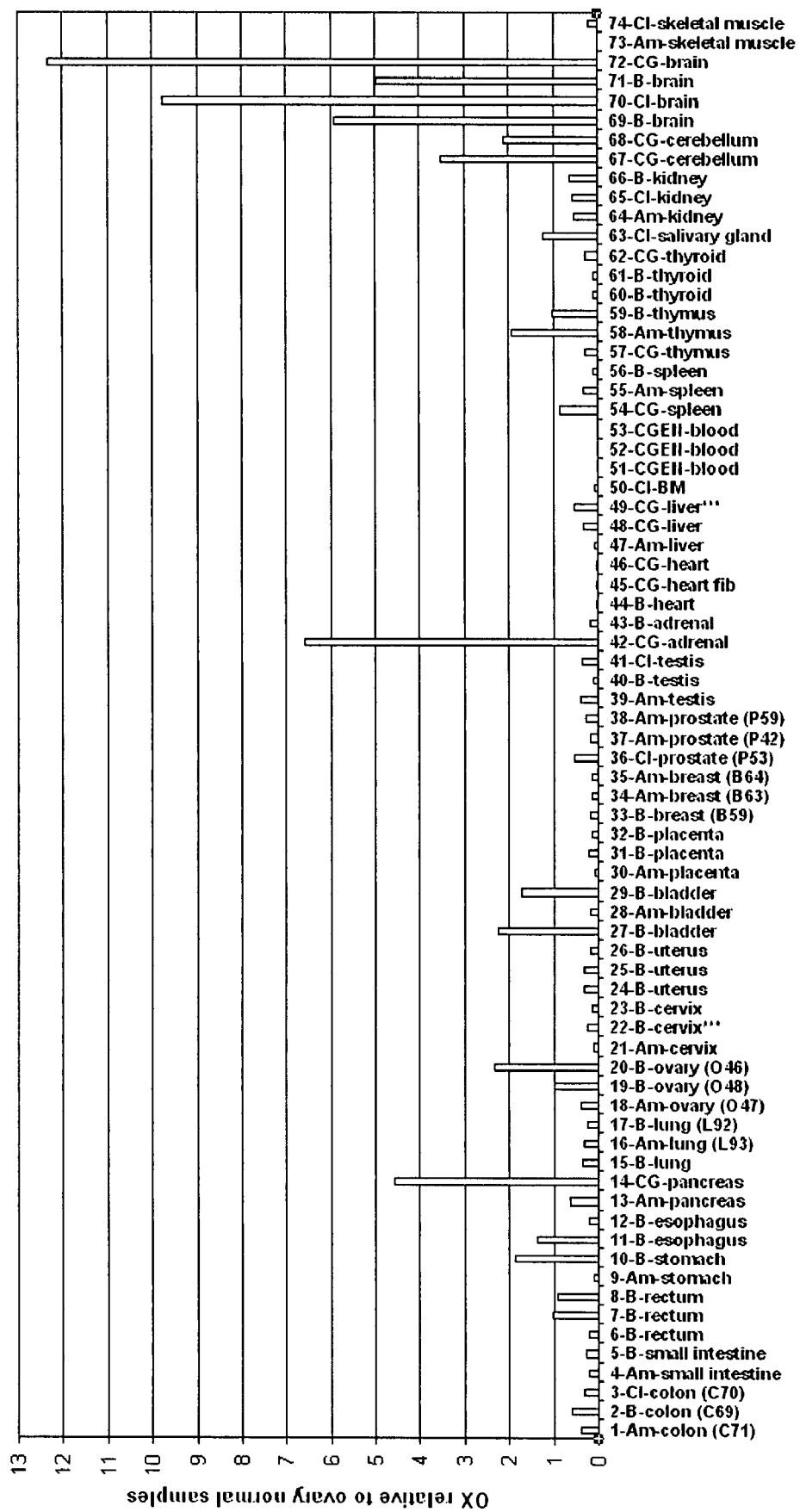
FIG. 73 is a histogram showing the expression of R11723 transcripts, which were detected by amplicon as depicted in the sequence name R11723 junc11-18 (SEQ ID NO:1687) in different normal tissues.

R11723 junc11-18—amplicon (SEQ ID NO:1687) AGT-GATGGAGCAAAGTGCCGGGATCATGTACCGCAAGT-CCTGTGCATCATCAGCGGCCTGTCTCATCG CCTCT-GCCGGGTACCAGTCCTTCTGCTCCCCAGGGAAAC-TGAACTCAGTTTTGCATCAGCTGCTG The results are demonstrated in FIG. 73, showing the expression of R11723 transcripts, which were detected by amplicon as depicted in the sequence name R11723 junc11-18 (SEQ ID NO:1687) in different normal tissues.

Cloning of this variant

Full length validation

RNA preparation

Human adult papillary adenocarcinoma ovary RNA pool (lot# ILS1408) was obtained from ABS (http://www.abs-bioreagents, Wilmington, Del. 19801, USA com). Total RNA samples were treated with DNaseI (Ambion Cat # 1906).

RT PCR

RT preparation

Purified RNA (1 ug) was mixed with 150 ng Random Hexamer primers (Invitrogen Cat # 48190-011) and 500 uM dNTP (Takara, Cat # B9501-1) in a total volume of 15.6 ul DEPC-$H_2O$ (Beit Haemek, Cat # 01-852-1A). The mixture was incubated for 5 min at 65° C. and then quickly chilled on ice. Thereafter, 5 ul of 5× Superscript II first strand buffer (Invitrogen, Cat #Y00146), 2.4 ul 0.1M DTT (Invitrogen, Cat #Y00147) and 40 units RNasin (Promega, Cat # N251A) were added, and the mixture was incubated for 2 min at 42° C. Then, 1 ul (200 units) of SuperscriptII (Invitrogen, Cat #18064-022) was added and the reaction was incubated for 50 min at 42° C. and then inactivated at 70° C. for 15 min. The resulting cDNA was diluted 1:20 in TE buffer (10 mM Tris pH=8, 1 mM EDTA pH=8).

PCR Amplification and Analysis cDNA (5 ul), prepared as described above, was used as a template in PCR reactions. The amplification was done using AccuPower PCR PreMix (Bioneer, Korea, Cat# K2016), under the following conditions: 1 ul—of each primer (10 uM)

PSECfor—TGCTGTCGCCTCCTCTGATG (SEQ ID NO:1777)

PSECrev—CCTCAGAAGGCACATGAAAG (SEQ ID NO:1778)

plus 13 ul —$H_2O$ were added into AccuPower PCR PreMix tube with a reaction program of 5 minutes at 94° C.; 35 cycles of: [30 seconds at 94° C., 30 seconds at 52° C., 40 seconds at 72° C.] and 10 minutes at 72° C. At the end of the PCR amplification, products were analyzed on agarose gels stained with ethidium bromide and visualized with LV light. PCR product was extracted from the gel using QiaQuick™ gel extraction kit (Qiagen™, Cat #28706). The extracted DNA product (FIG. 79) was sequenced by direct sequencing using the gene specific primers from above (Hy-Labs, Israel), resulting in the expected sequence of PSEC variant R11723_PEA_1 T5 (SEQ ID NO:148) (FIG. 80).

It was concluded that the predicted PSEC variant R11723_PEA_1 T5 (SEQ ID NO:148) is indeed a naturally expressed variant in an adult papillary adenocarcinoma ovary human tissue as shown in FIG. 79.

Cloning of PSEC variant R11723_PEA_1 T5 (SEQ ID NO:148) into bacterial expression vector The PSEC splice variant R11723_PEA_1 T5 (SEQ ID NO:148) coding sequence was prepared for cloning by PCR amplification using the fragment described above as template and Platinum Pfx DNA polymerase (Invitrogen Cat # 11708021) under the following conditions: 5 ul—Amplification ×10 buffer (Invitrogen Cat # 11708021); 2 ul —PCR product from above; 1 ul—dNTPs (10 mM each); 1 µl $MgSO_4$ (50 mM) 5 ul enhancer solution (Invitrogen Cat # 11708021); 33 ul —$H_2O$; 1 ul—of each primer (10 uM) and 1.25 units of Taq polymerase [Platinum Pfx DNA polymerase (Invitrogen Cat # 11708021)] in a total reaction volume of 50 ul with a reaction program of 3 minutes at 94° C.; 29 cycles of: [30 seconds at 94° C., 30 seconds at 58° C., 40 seconds at 68° C.] and 7 minutes at 68° C. The Primers listed below include specific sequences of the nucleotide sequence corresponding to the splice variant and NheI and HindIII restriction sites.

PSEC NheIfor—ATAGCTAGCATGTGGGTCCTAG-GCATCGCGG (SEQ ID NO:1779)

PSEC HindIIIrev—CCCAAGCTTCTAAGTGGTCAACT-GCTTGGC (SEQ ID NO:1780)

Figure 81:
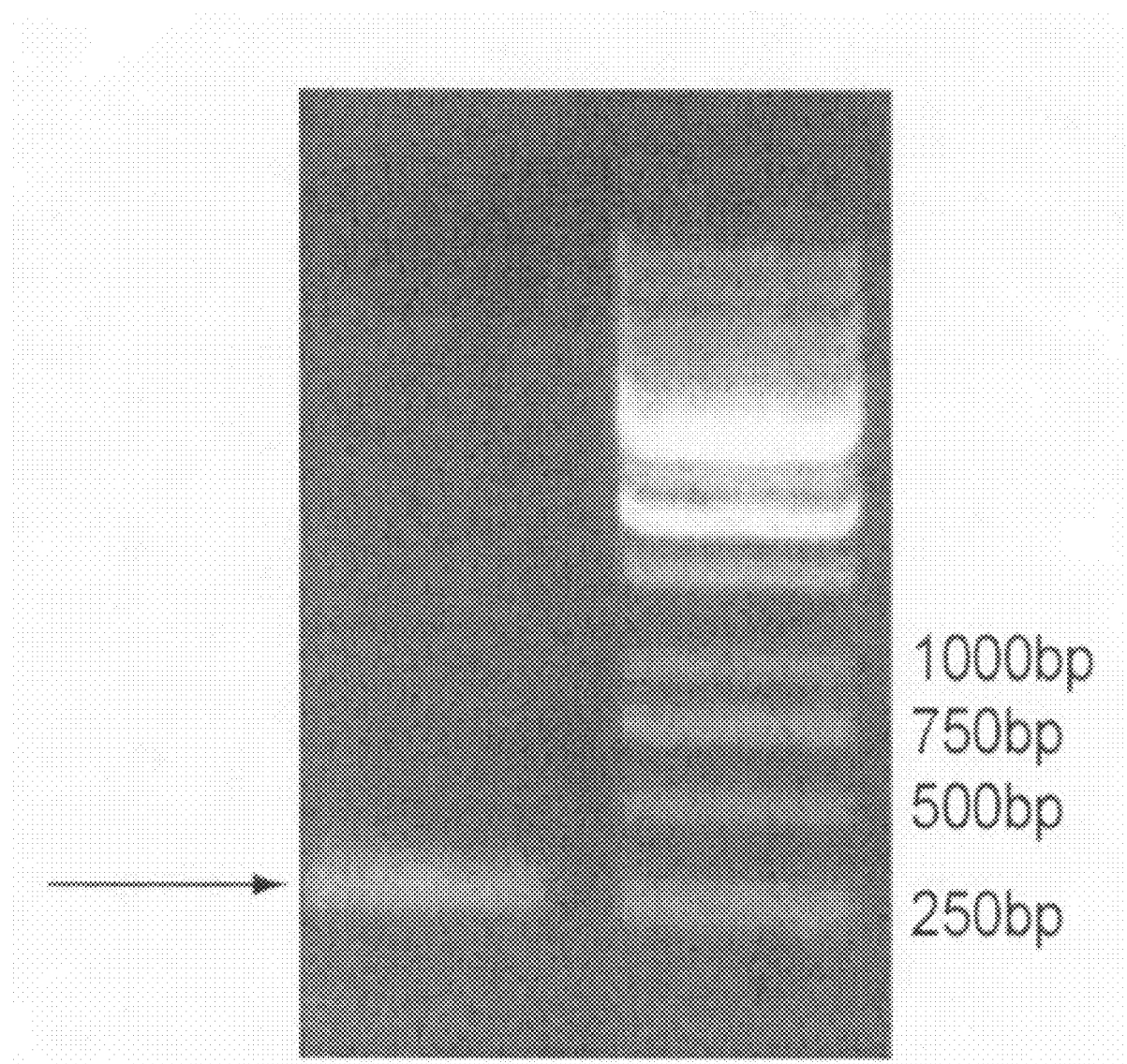
FIG. 81—PRSEC PCR product digested with NheI and HindIII; Lane 1—PRSET PCR product; Lane 2-Fermentas GeneRuler 1 Kb DNA Ladder #SM0313.
Figure 82:
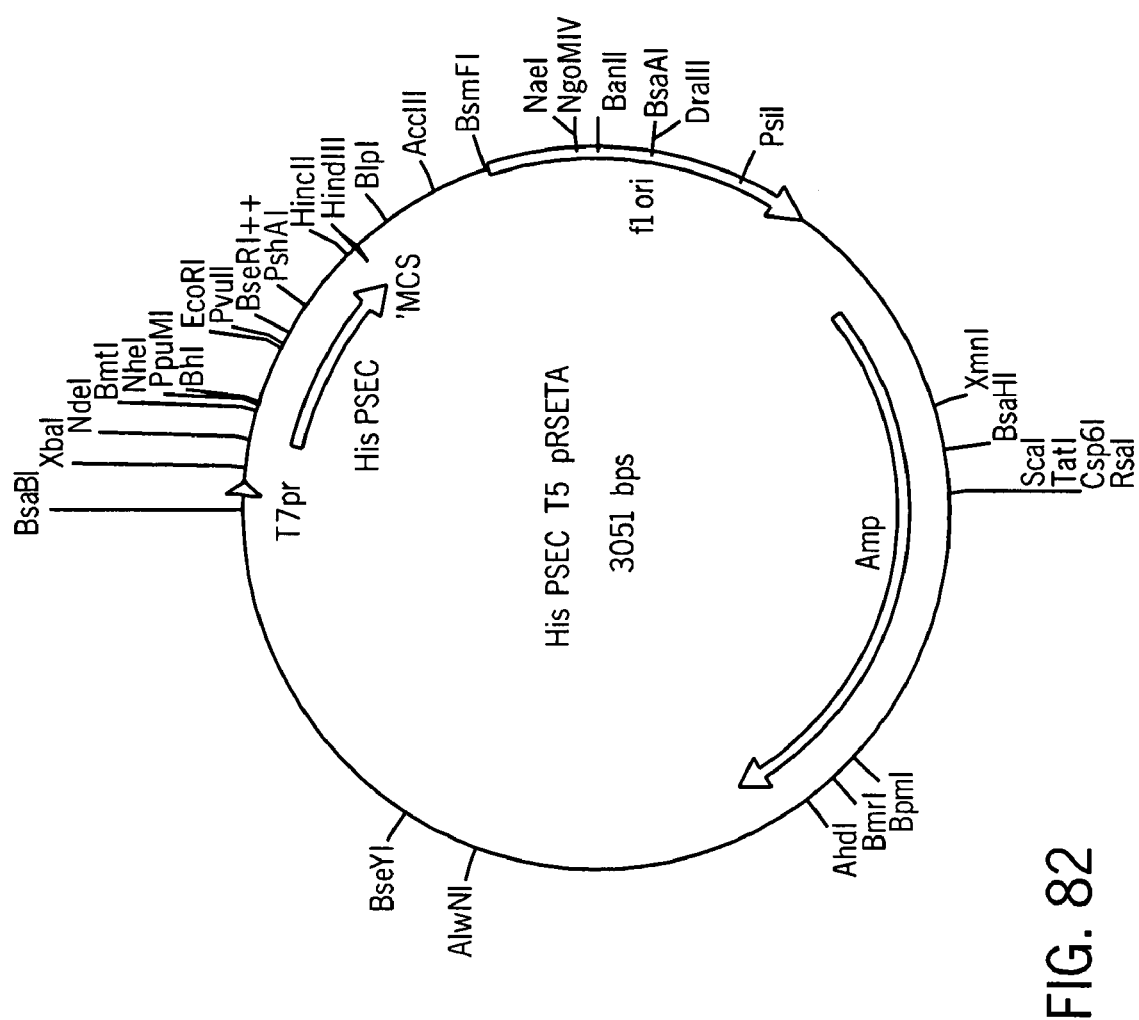
FIG. 82 shows a plasmid map of His PSEC T5 pRSETA.

The PCR product was then double digested with NheI and Hind111 (New England Biolabs (UK) LTD) (FIG. 81), and inserted into pRSET-A (Invitrogen, Cat# V351-20), previously digested with the same enzymes, in-frame to an N-terminal 6His-tag, to give His PSEC T5 pRSET (FIG. 82). The coding sequence encodes for a protein having the 6His-tag at the N' end (6His residues in a row at one end of the protein), and 8 additional amino acids encoded by the pRSET vector.

The sequence of the PSEC insert in the final plasmid, as well as its flanking regions, were verified by sequencing and found to be identical to the desired sequences. The complete sequence of His PSEC T5 pRESTA, including the sequenced regions, is shown in FIG. 84.

FIG. 83 shows the translated sequence of PSEC variant R11723_PEA_1 T5 (SEQ ID NO:148).

Bacterial Culture and Induction of Protein Expression

His PSEC pRSETA DNA was transformed into competent DH5a cells (Invitrogen Cat#18258-012). Ampicillin resistant transformants were screened and positive clones were further analyzed by restriction enzyme digestion and sequence verification.

In order to express the recombinant protein, His PSEC pRSETA DNA was further transformed into competent BL21Gold cells (Stratagene Cat#230134) and BL21star (Invitrogen Cat# 44-0054). Ampicillin resistant transformants were screened and positive clones were selected.

Bacterial cells containing the HisPSEC T5 pRSET vector or empty pRSET vector (as negative control) were grown in LB medium, supplemented with Ampicillin (50 ug/ml) and chloramphenicol (34 ug/ml), until O.D.600 nm reached 0.55. This value was reached in about 3 hours. 1 mM IPTG (Roche, Cat #724815) was added and the cells were grown at 37° C. overnight. 1 ml aliquots of each culture were removed for gel analysis at time zero, 3 hrs after induction and following overnight incubation (T0, T3 and TO/N, respectively).

Expression Results

Figure 85:
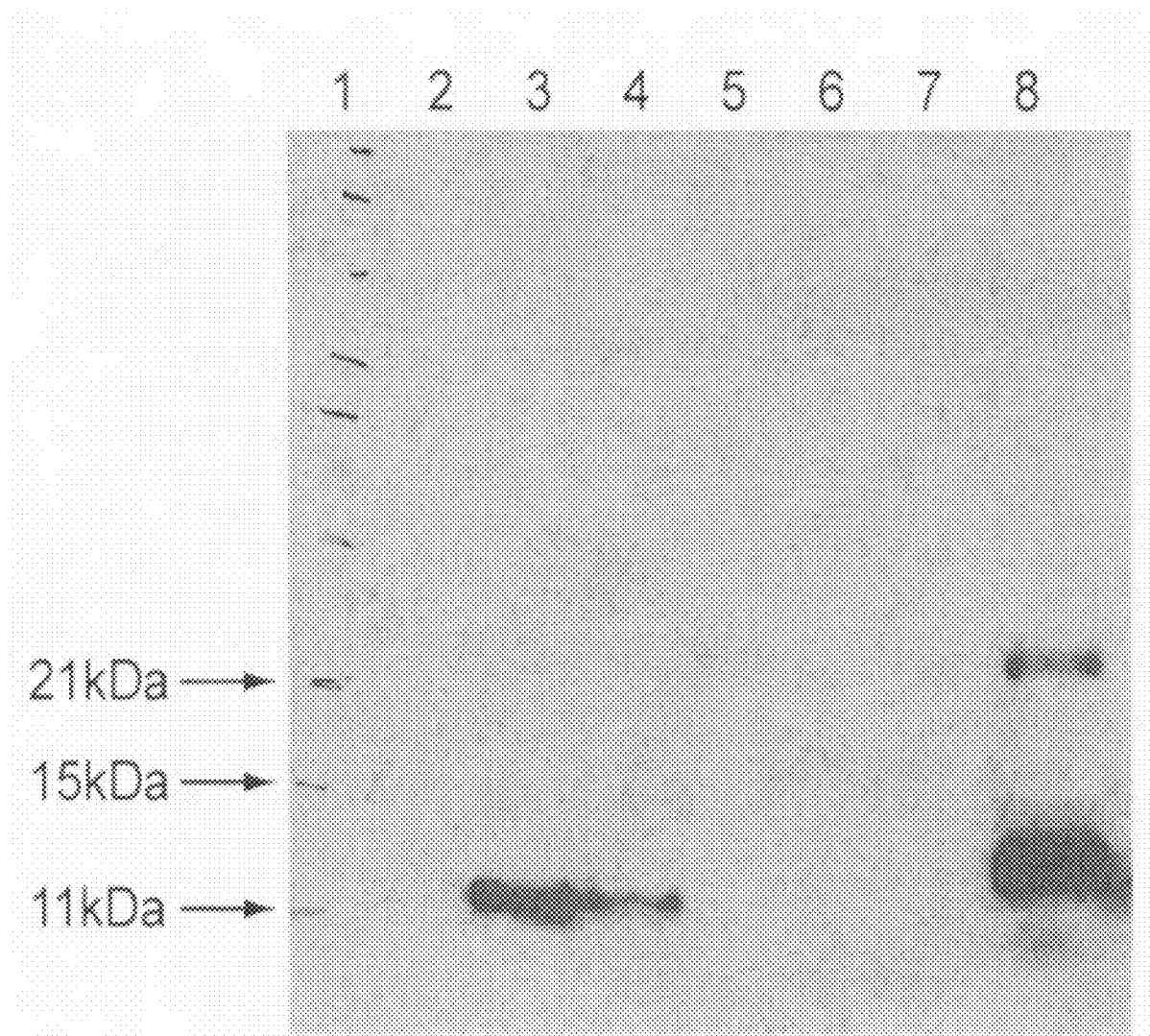
FIG. 85 shows Western blot analysis of recombinant His PSEC variant R11723_PEA_1 T5; lane 1: molecular weight marker (ProSieve color, Cambrex, Cat #50550); lane 2: His PSEC T5 pRSETA T0; lane 3: His His PSEC T5 pRSETA T3; lane 4:His His PSEC T5 pRSETA To.n; lane 5: pRSET empty vector T0 (negative control); lane 6: pRSET empty vector T3 (negative control); lane 7: pRSET empty vector To.n (negative control); and lane 8: His positive control protein (His-TroponinT7 pRSETA T3).

The time course of small-scale expression of PSEC in BL21Gold is demonstrated in FIG. 85. The expression of a recombinant protein with the appropriate molecular weight (9.2 kDa) was visualized by Western Blot with anti-His antibodies (BD Clontech, Ref 631212, FIG. 85), but not by Coomassie staining (data not shown). Similar expression pattern was obtained with BL21 star as well (data not shown).

These results show that the protein encoded by PSEC variant R11723_PEA_1 T5 (SEQ ID NO:148) is indeed expressed in bacterial cells.

Description for Cluster R16276

Cluster R16276 features 1 transcript(s) and 5 segment(s) of interest, the names for which are given in Tables 1278 and 1279, respectively, the sequences themselves are given at the end of the application. The selected protein variants are given in table 1280.

TABLE 1278

Transcripts of interest

| Transcript Name | Sequence ID No. |
| --- | --- |
| R16276_PEA_1_T6 | 150 |

TABLE 1279

Segments of interest

| Segment Name | Sequence ID No. |
| --- | --- |
| R16276_PEA_1_node_0 | 1017 |
| R16276_PEA_1_node_6 | 1018 |
| R16276_PEA_1_node_1 | 1019 |
| R16276_PEA_1_node_4 | 1020 |
| R16276_PEA_1_node_5 | 1021 |

TABLE 1280

Proteins of interest

| Protein Name | Sequence ID No. | Corresponding Transcript(s) |
| --- | --- | --- |
| R16276_PEA_1_P7 | 1414 | R16276_PEA_1_T6 (SEQ ID NO:150) |

These sequences are variants of the known protein NOV protein homolog precursor (SwissProt accession identifier NOV_HUMAN; known also according to the synonyms NovH; Nephroblastoma overexpressed gene protein homolog), SEQ ID NO:1463, referred to herein as the previously known protein.

Protein NOV protein homolog precursor (SEQ ID NO:1463) is known or believed to have the following function(s): Immediate-early protein, likely to play a role in cell growth regulation (By similarity). The sequence for protein NOV protein homolog precursor is given at the end of the application, as "NOV protein homolog precursor amino acid sequence". Known polymorphisms for this sequence are as shown in Table 1281.

TABLE 1281

Amino acid mutations for Known Protein

| SNP position(s) on amino acid sequence | Comment |
| --- | --- |
| 97 | N -> K |

Protein NOV protein homolog precursor (SEQ ID NO:1463) localization is believed to be Secreted.

The following GO Annotation(s) apply to the previously known protein. The following annotation(s) were found: regulation of cell growth, which are annotation(s) related to Biological Process; insulin-like growth factor binding; growth factor, which are annotation(s) related to Molecular Function; and extracellular, which are annotation(s) related to Cellular Component.

The GO assignment relies on information from one or more of the SwissProt/TremBl Protein knowledgebase, available from <dot expasy dot ch/sprot/>; or Locuslink, available from <dot ncbi dot nlm dot nih dot gov/projects/LocusLink/>.

Cluster R16276 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 51 refer to weighted expression of ESTs in each category, as "parts per million" (ratio of the expression of ESTs for a particular cluster to the expression of all ESTs in that category, according to parts per million).

Figure 51:
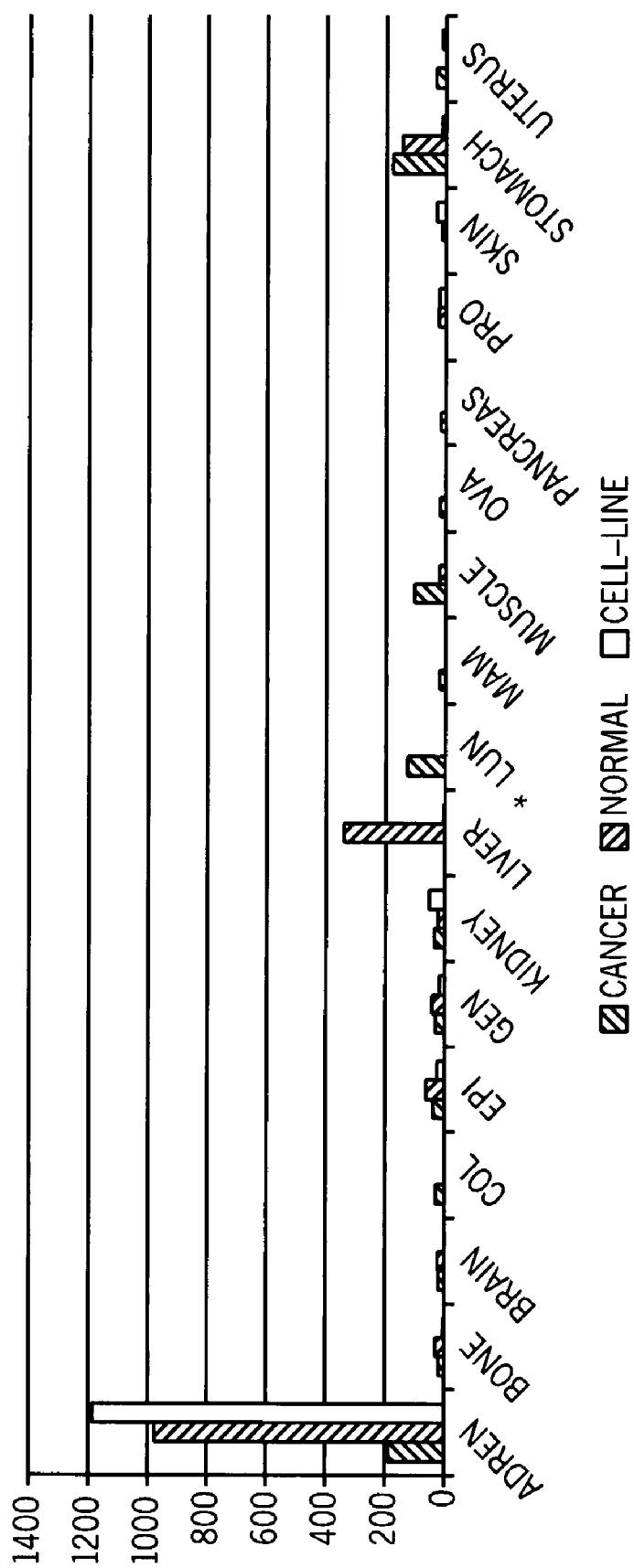
FIG. 51 is a histogram showing Cancer and cell-line vs. normal tissue expression for Cluster R16276, demonstrating overexpression in: lung malignant tumors.

Overall, the following results were obtained as shown with regard to the histograms in FIG. 51 and Table 1282. This cluster is overexpressed (at least at a minimum level) in the following pathological conditions: lung malignant tumors.

TABLE 1282

Normal tissue distribution

| Name of Tissue | Number |
| --- | --- |
| Adrenal | 977 |
| Bone | 32 |
| Brain | 24 |
| Colon | 0 |
| Epithelial | 63 |
| General | 43 |
| Kidney | 24 |
| Liver | 341 |
| Lung | 0 |
| Breast | 0 |
| Muscle | 20 |
| Ovary | 0 |
| Pancreas | 0 |
| Prostate | 24 |
| Skin | 13 |
| Stomach | 146 |
| Uterus | 0 |

TABLE 1283

P values and ratios for expression in cancerous tissue

| Name of Tissue | P1 | P2 | SP1 | R3 | SP2 | R4 |
| --- | --- | --- | --- | --- | --- | --- |
| Adrenal | 5.9e−01 | 6.2e−01 | 1 | 0.2 | 9.9e−01 | 0.2 |
| Bone | 5.5e−01 | 7.3e−01 | 1 | 0.8 | 1 | 0.6 |
| Brain | 2.8e−01 | 4.4e−01 | 6.8e−01 | 0.9 | 8.9e−01 | 0.6 |

TABLE 1283-continued

P values and ratios for expression in cancerous tissue

| Name of Tissue | P1 | P2 | SP1 | R3 | SP2 | R4 |
|---|---|---|---|---|---|---|
| Colon | 2.6e–01 | 3.3e–01 | 4.9e–01 | 2.0 | 5.9e–01 | 1.7 |
| Epithelial | 2.6e–01 | 2.9e–01 | 9.7e–01 | 0.6 | 1 | 0.5 |
| General | 4.1e–01 | 6.8e–01 | 9.4e–01 | 0.7 | 1 | 0.5 |
| Kidney | 8.3e–01 | 7.7e–01 | 6.2e–01 | 1.2 | 5.3e–01 | 1.4 |
| Liver | 9.1e–01 | 7.5e–01 | 1 | 0.1 | 1 | 0.1 |
| Lung | 2.3e–02 | 9.1e–02 | 8.0e–04 | 10.5 | 2.1e–02 | 5.1 |
| Breast | 5.9e–01 | 6.7e–01 | 6.9e–01 | 1.5 | 8.2e–01 | 1.2 |
| Muscle | 5.2e–01 | 6.1e–01 | 2.7e–01 | 3.2 | 6.3e–01 | 1.2 |
| Ovary | 6.2e–01 | 6.5e–01 | 6.8e–01 | 1.5 | 7.7e–01 | 1.3 |
| Pancreas | 3.3e–01 | 4.4e–01 | 4.2e–01 | 2.4 | 5.3e–01 | 1.9 |
| Prostate | 9.3e–01 | 9.4e–01 | 1 | 0.5 | 9.4e–01 | 0.6 |
| Skin | 9.2e–01 | 6.8e–01 | 1 | 0.5 | 4.1e–01 | 1.1 |
| Stomach | 5.0e–01 | 7.3e–01 | 5.0e–01 | 0.6 | 9.7e–01 | 0.4 |
| Uterus | 2.4e–01 | 1.6e–01 | 2.9e–01 | 2.5 | 4.1e–01 | 2.0 |

As noted above, cluster R16276 features 1 transcript(s), which were listed in Table 1278 above. These transcript(s) encode for protein(s) which are variant(s) of protein NOV protein homolog precursor (SEQ ID NO:1463). A description of each variant protein according to the present invention is now provided.

Variant protein R16276_PEA_1_P7 (SEQ ID NO:1414) according to the present invention has an amino acid sequence as given at the end of the application; it is encoded by transcript(s) R16276_PEA_1_T6 (SEQ ID NO:150). An alignment is given to the known protein (NOV protein homolog precursor (SEQ ID NO:1463)) at the end of the application. One or more alignments to one or more previously published protein sequences are given at the end of the application. A brief description of the relationship of the variant protein according to the present invention to each such aligned protein is as follows:

Comparison report between R16276_PEA_1_P7 (SEQ ID NO:1414) and NOV HUMAN (SEQ ID NO:1463):

1. An isolated chimeric polypeptide encoding for R16276_PEA_1_P7 (SEQ ID NO:1414), comprising a first amino acid sequence being at least 90% homologous to MQSVQSTSFCLRKQCLCLTFLLLHLLGQVAATQRCP-PQCPG corresponding to amino acids 1-41 of NOV_HUMAN (SEQ ID NO:1463), which also corresponds to amino acids 1-41 of R16276_PEA_1_P7 (SEQ ID NO:1414), abridging amino acid Q corresponding to amino acid 42 of R16276_PEA_1_P7 (SEQ ID NO:1414), a second amino acid sequence being at least 90% homologous to CPATPPT-CAPGVRAVLDGCSCCLVCARQRGESCSDLEPCD-ESSGLYCDRSADPSNQTGICT corresponding to amino acids 43-103 of NOV_HUMAN (SEQ ID NO:1463), which also corresponds to amino acids 43-103 of R16276_PEA_1_P7 (SEQ ID NO:1414), and a third amino acid sequence being at least 70%, optionally at least 80%, preferably at least 85%, more preferably at least 90% and most preferably at least 95% homologous to a polypeptide having the sequence GNPAPSAV (SEQ ID NO:1748) corresponding to amino acids 104-111 of R16276_PEA_1_P7 (SEQ ID NO:1414), wherein said first amino acid sequence, bridging amino acid, second amino acid sequence and third amino acid sequence are contiguous and in a sequential order.

2. An isolated polypeptide encoding for a tail of R16276_PEA_1_P7 (SEQ ID NO:1414), comprising a polypeptide being at least 70%, optionally at least about 80%, preferably at least about 85%, more preferably at least about 90% and most preferably at least about 95% homologous to the sequence GNPAPSAV (SEQ ID NO: 1748) in R16276PEA_1_P7 (SEQ ID NO:1414).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R16276_PEA_1_P7 (SEQ ID NO:1414) also has the following non-silent SNPs (Single Nucleotide Polymorphisms) as listed in Table 1284, (given according to their position(s) on the amino acid sequence, with the alternative amino acid(s) listed; the last column indicates whether the SNP is known or not; the presence of known SNPs in variant protein R16276_PEA_1_P7 (SEQ ID NO:1414) sequence provides support for the deduced sequence of this variant protein according to the present invention).

TABLE 1284

Amino acid mutations

| SNP position(s) on amino acid sequence | Alternative amino acid(s) | Previously known SNP? |
|---|---|---|
| 42 | Q -> R | Yes |

The glycosylation sites of variant protein R16276_PEA_1_P7 (SEQ ID NO:1414), as compared to the known protein NOV protein homolog precursor (SEQ ID NO:1463), are described in Table 1285 (given according to their position(s) on the amino acid sequence in the first column; the second column indicates whether the glycosylation site is present in the variant protein; and the last column indicates whether the position is different on the variant protein).

TABLE 1285

Glycosylation site(s)

| Position(s) on known amino acid sequence | Present in variant protein? | Position in variant protein? |
|---|---|---|
| 280 | no | |
| 97 | yes | 97 |

Variant protein R16276_PEA_1_P7 (SEQ ID NO:1414) is encoded by the following transcript(s): R16276_PEA_1_T6 (SEQ ID NO:150), for which the sequence(s) is/are given at the end of the application. The coding portion of transcript R16276_PEA_1_T6 (SEQ ID NO:150) is shown in bold; this coding portion starts at position 445 and ends at position 777. The transcript also has the following SNPs as listed in Table 1286 (given according to their position on the nucleotide sequence, with the alternative nucleic acid listed; the last column indicates whether the SNP is known or not; the presence of known SNPs in variant protein R16276_PEA_1_P7 (SEQ ID NO:1414) sequence provides support for the deduced sequence of this variant protein according to the present invention).

TABLE 1286

Nucleic acid SNPs

| SNP position on nucleotide sequence | Alternative nucleic acid | Previously known SNP? |
|---|---|---|
| 371 | G -> | No |
| 430 | A -> G | No |
| 569 | A -> G | Yes |
| 729 | C -> A | Yes |
| 827 | G -> T | Yes |

As noted above, cluster R16276 features 5 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster R16276_PEA_1_node_0 (SEQ ID NO:1017) according to the present invention is supported by 35 libraries. The number of libraries was determined as previously described. This segment can be found in the following transcript(s): R16276_PEA_1_T6 (SEQ ID NO:150). Table 1287 below describes the starting and ending position of this segment on each transcript.

TABLE 1287

Segment location on transcripts

| Transcript name | Segment starting position | Segment ending position |
|---|---|---|
| R16276_PEA_1_T6 (SEQ ID NO:150) | 1 | 438 |

Segment cluster R16276_PEA_1_node_6 (SEQ ID NO:1018) according to the present invention is supported by 2 libraries. The number of libraries was determined as previously described. This segment can be found in the following transcript(s): R16276_PEA_1_T6 (SEQ ID NO:150). Table 1288 below describes the starting and ending position of this segment on each transcript.

TABLE 1288

Segment location on transcripts

| Transcript name | Segment starting position | Segment ending position |
|---|---|---|
| R16276_PEA_1_T6 (SEQ ID NO:150) | 755 | 876 |

According to an optional embodiment of the present invention, short segments related to the above cluster are also provided. These segments are up to about 120 bp in length, and so are included in a separate description.

Segment cluster R16276_PEA_1_node_1 (SEQ ID NO:1019) according to the present invention is supported by 37 libraries. The number of libraries was determined as previously described. This segment can be found in the following transcript(s): R16276_PEA_1_T6 (SEQ ID NO:150). Table 1289 below describes the starting and ending position of this segment on each transcript.

TABLE 1289

Segment location on transcripts

| Transcript name | Segment starting position | Segment ending position |
|---|---|---|
| R16276_PEA_1_T6 (SEQ ID NO:150) | 439 | 528 |

Segment cluster R16276_PEA_1_node_4 (SEQ ID NO:1020) according to the present invention is supported by 38 libraries. The number of libraries was determined as previously described. This segment can be found in the following transcript(s): R16276_PEA_1_T6 (SEQ ID NO:150). Table 1290 below describes the starting and ending position of this segment on each transcript.

TABLE 1290

Segment location on transcripts

| Transcript name | Segment starting position | Segment ending position |
|---|---|---|
| R16276_PEA_1_T6 (SEQ ID NO:150) | 529 | 639 |

Segment cluster R16276_PEA_1_node_5 (SEQ ID NO:1021) according to the present invention is supported by 37 libraries. The number of libraries was determined as previously described. This segment can be found in the following transcript(s): R16276_PEA_1_T6 (SEQ ID NO:150). Table 1291 below describes the starting and ending position of this segment on each transcript.

TABLE 1291

Segment location on transcripts

| Transcript name | Segment starting position | Segment ending position |
|---|---|---|
| R16276_PEA_1_T6 (SEQ ID NO:150) | 640 | 754 |

Variant protein alignment to the previously known protein:

Sequence name: NOV_HUMAN (SEQ ID NO:1463)

Sequence documentation:

Alignment of: R16276_PEA_1_P7 (SEQ ID NO:1414) x NOV_HUMAN (SEQ ID NO:1463)

Alignment segment 1/1:

| | |
|---|---|
| Quality: 1042.00 | Escore: 0 |
| Matching length: 103 | Total length: 103 |
| Matching Percent Similarity: 100.00 | Matching Percent Identity: 99.03 |
| Total Percent Similarity: 100.00 | Total Percent Identity: 99.03 |
| Gaps: 0 | |

Alignment:

```
  1  MQSVQSTSFCLRKQCLCLTFLLLHLLGQVAATQRCPPQCPGQCPATPPTC   50
     |||||||||||||||||||||||||||||||||||||||||:||||||||
  1  MQSVQSTSFCLRKQCLCLTFLLLHLLGQVAATQRCPPQCPGRCPATPPTC   50

51  APGVRAVLDGCSCCLVCARQRGESCSDLEPCDESSGLYCDRSADPSNQTG  100
     |||||||||||||||||||||||||||||||||||||||||||||||||
 51  APGVRAVLDGCSCCLVCARQRGESCSDLEPCDESSGLYCDRSADPSNQTG  100

101  ICT                                                103
     |||
101  ICT                                                103
```

Combined Expression of 6 Sequences H61775seg8 (SEQ ID NO: 1636), HUMGRP5E junc3-7 (SEQ ID NO: 1648), M85491Seg24 (SEQ ID NO:1639), Z21368 junc17-21 (SEQ ID NO:1642), HSSTROL3seg24 (SEQ ID NO:1675) and Z25299seg20 (SEQ ID NO: 1669) in Normal and Cancerous Lung Tissues Expression of immunoglobulin superfamily, member 9, gastrin-releasing peptide, Ephrin type-B receptor 2 precursor, SUL1_HUMAN, Stromelysin-3 precursor (EC 3.4.24.-) (Matrix metalloproteinase-11) (MMP-1) (ST3) (SL-3) and Secretory leukocyte protease inhibitor Acid-stable proteinase inhibitor transcripts detectable by or according to H61775seg8 (SEQ ID NO:1636), HUMGRP5E junc3-7 (SEQ ID NO:1648), M85491Seg24 (SEQ ID NO: 1639), Z21368 junc17-21 (SEQ ID NO: 1642), HSSTROL3seg24 (SEQ ID NO: 1675) and Z25299seg20 amplicons (SEQ ID NO: 1669) and H61775seg8F2 (SEQ ID NO: 1634), H61775seg8R2 (SEQ ID NO: 1635), HUMGRP5E junc3-7F (SEQ ID NO: 1646), HUMGRP5E junc3-7R (SEQ ID NO: 1647), M85491 Seg24F (SEQ ID NO: 1637), M85491Seg24R (SEQ ID NO: 1638), Z21368 junc17-21F (SEQ ID NO: 1640), Z21368 junc17-21R (SEQ ID NO: 1641), HSSTROL3seg24F (SEQ ID NO: 1673), HSSTROL3seg24R (SEQ ID NO: 1674), Z25299seg20F (SEQ ID NO: 1667), Z25299seg20R (SEQ ID NO: 1668) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), Ubiquitin (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicons was normalized to the geometric mean of the quantities of the housekeeping genes. The normalized quantity of each RT sample of each amplicon was then divided by the median of the quantities of the normal post-mortem (PM) samples detected for the same amplicon (Sample Nos. 47-50, 90-93, 96-99, Table 2, "Tissue samples in testing panel", above), to obtain a value of fold up-regulation for each sample relative to median of the normal PM samples. The reciprocal of this ratio was calculated for Z25299seg20 (SEQ ID NO: 1669), to obtain a value of fold down-regulation for each sample relative to median of the normal PM samples.

Figure 52A:
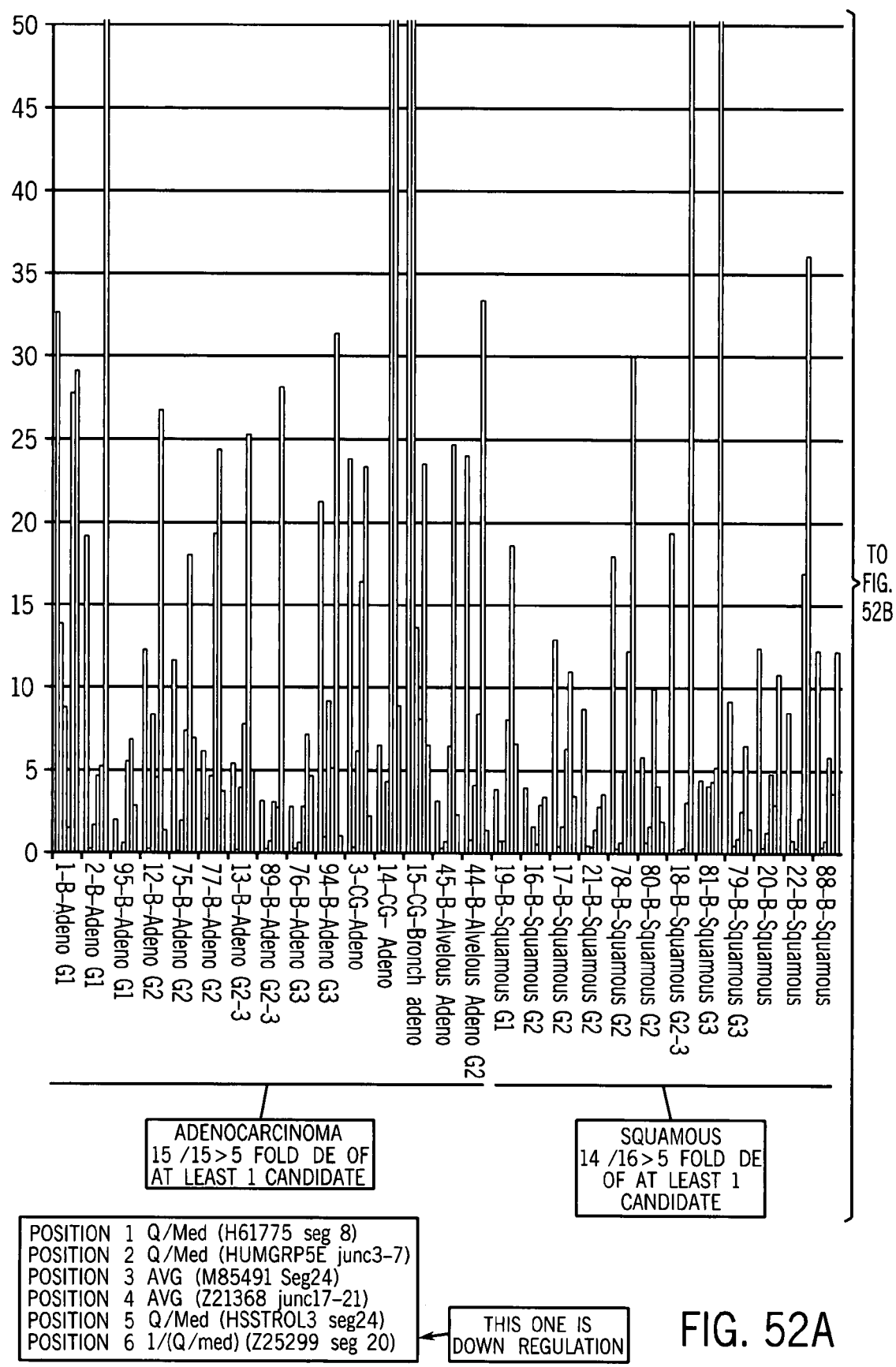
FIGS. 52-53 are histograms, showing differential expression of the 6 sequences H61775seg8 (SEQ ID NO:1636), HUMGRP5E junc3-7 (SEQ ID NO:1648), M85491Seg24 (SEQ ID NO:1639), Z21368 junc17-21 (SEQ ID NO:1642), HSSTROL3seg24 (SEQ ID NO:1675) and Z25299seg20 (SEQ ID NO:1669) in in cancerous lung samples relative to the normal samples.
Figure 52B:
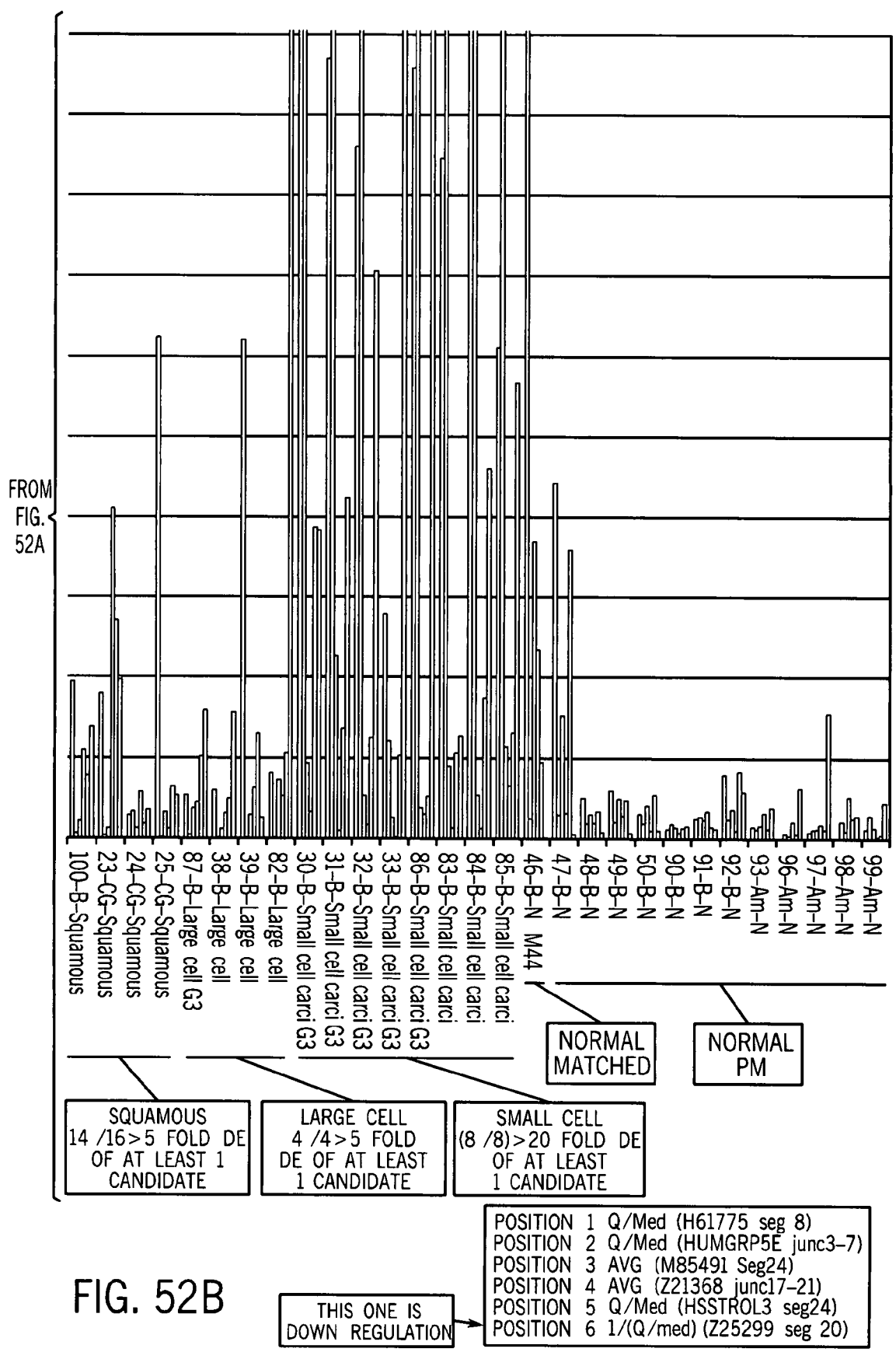
Figure 53A:
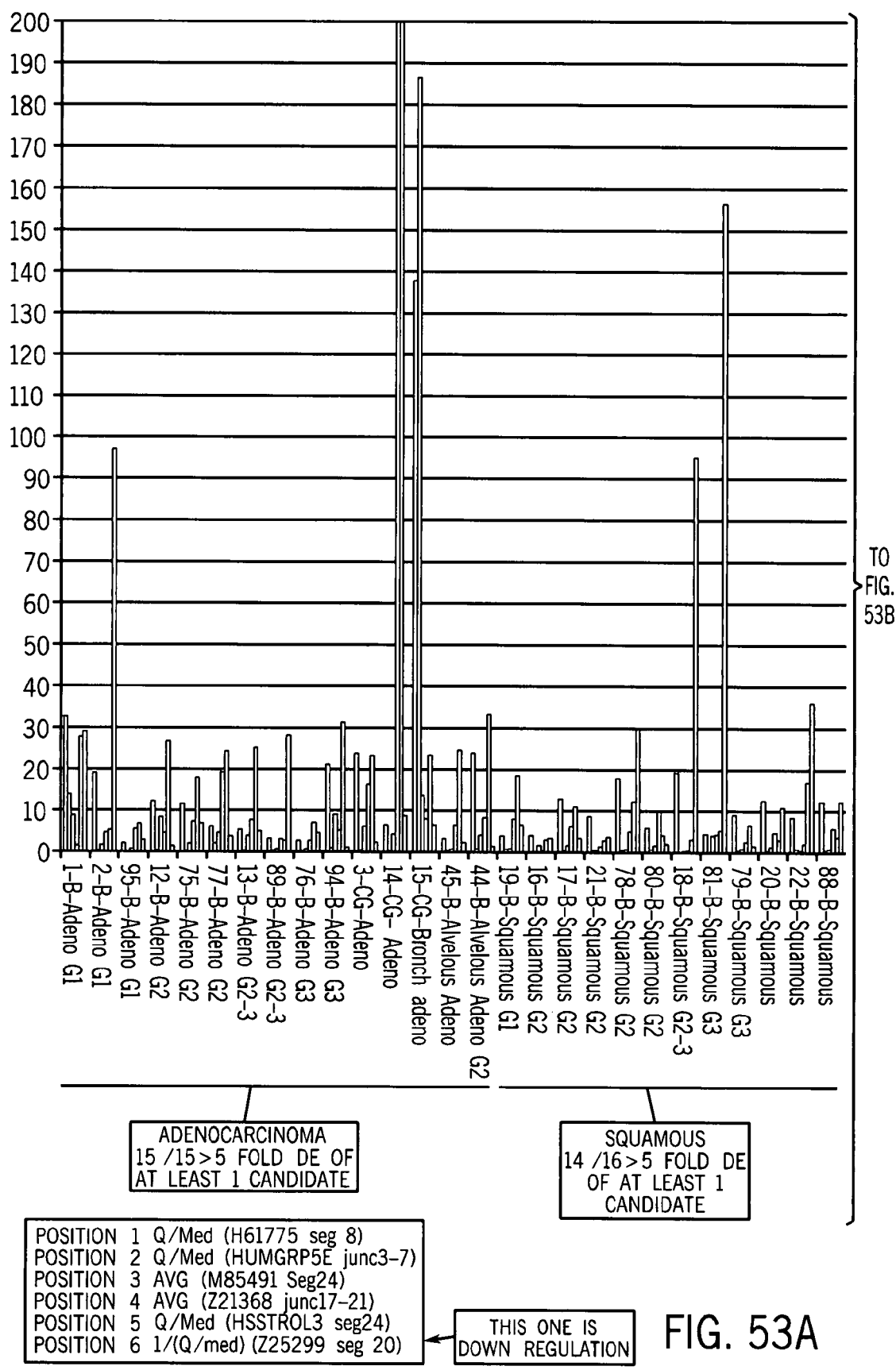

FIGS. 52-53 are histograms showing differential expression of the above-indicated transcripts in cancerous lung samples relative to the normal samples. The number and percentage of samples that exhibit at least 5 fold differential of at least one of the sequences, out of the total number of samples tested is indicated in the bottom.

As is evident from FIGS. 52-53, differential expression of at least 5 fold in at least one of the sequences was found in 15 out of 15 adenocarcinoma samples, 14 out of 16 squamous cell carcinoma samples, 4 out of 4 large cell carcinoma samples and in 8 out of 8 small cell carcinoma samples.

Statistical analysis was applied to verify the significance of these results, as described below. Threshold of 5 fold differential expression of at least one of the amplicons was found to differentiate between cancer and normal samples with P value of 7.82E-06 in adenocarcinoma, 2.63E-04 in squamous cell carcinoma, 8.24E-03 in large cell adenocarcinoma and 3.57E-04 in small cell carcinoma as checked by exact fisher test.

The above values demonstrate statistical significance of the results.

Description for Cluster H53626

Cluster H53626 features 2 transcript(s) and 20 segment(s) of interest, the names for which are given in Tables 1292 and 1293, respectively, the sequences themselves are given at the end of the application.

TABLE 1292

Transcripts of interest

| Transcript Name | SEQ ID NO: |
|---|---|
| H53626_PEA_1_T15 | 16 |
| H53626_PEA_1_T16 | 17 |

TABLE 1293

Segments of interest

| Segment Name | SEQ ID NO: |
|---|---|
| H53626_PEA_1_node_15 | 18 |
| H53626_PEA_1_node_22 | 19 |
| H53626_PEA_1_node_25 | 306 |
| H53626_PEA_1_node_26 | 307 |
| H53626_PEA_1_node_27 | 308 |
| H53626_PEA_1_node_34 | 309 |
| H53626_PEA_1_node_35 | 310 |
| H53626_PEA_1_node_36 | 311 |
| H53626_PEA_1_node_11 | 312 |
| H53626_PEA_1_node_12 | 313 |
| H53626_PEA_1_node_16 | 314 |
| H53626_PEA_1_node_19 | 315 |
| H53626_PEA_1_node_20 | 316 |
| H53626_PEA_1_node_24 | 317 |

TABLE 1293-continued

Segments of interest

| Segment Name | SEQ ID NO: |
| --- | --- |
| H53626_PEA_1_node_28 | 318 |
| H53626_PEA_1_node_29 | 319 |
| H53626_PEA_1_node_30 | 320 |
| H53626_PEA_1_node_31 | 321 |
| H53626_PEA_1_node_32 | 322 |
| H53626_PEA_1_node_33 | 323 |

TABLE 1294

Proteins of interest

| Transcript Name | SEQ ID NO: |
| --- | --- |
| H53626_PEA_1_P4 | 324 |
| H53626_PEA_1_P5 | 325 |

Cluster H53626 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 76 below refer to weighted expression of ESTs in each category, as "parts per million" (ratio of the expression of ESTs for a particular cluster to the expression of all ESTs in that category, according to parts per million).

Figure 76:
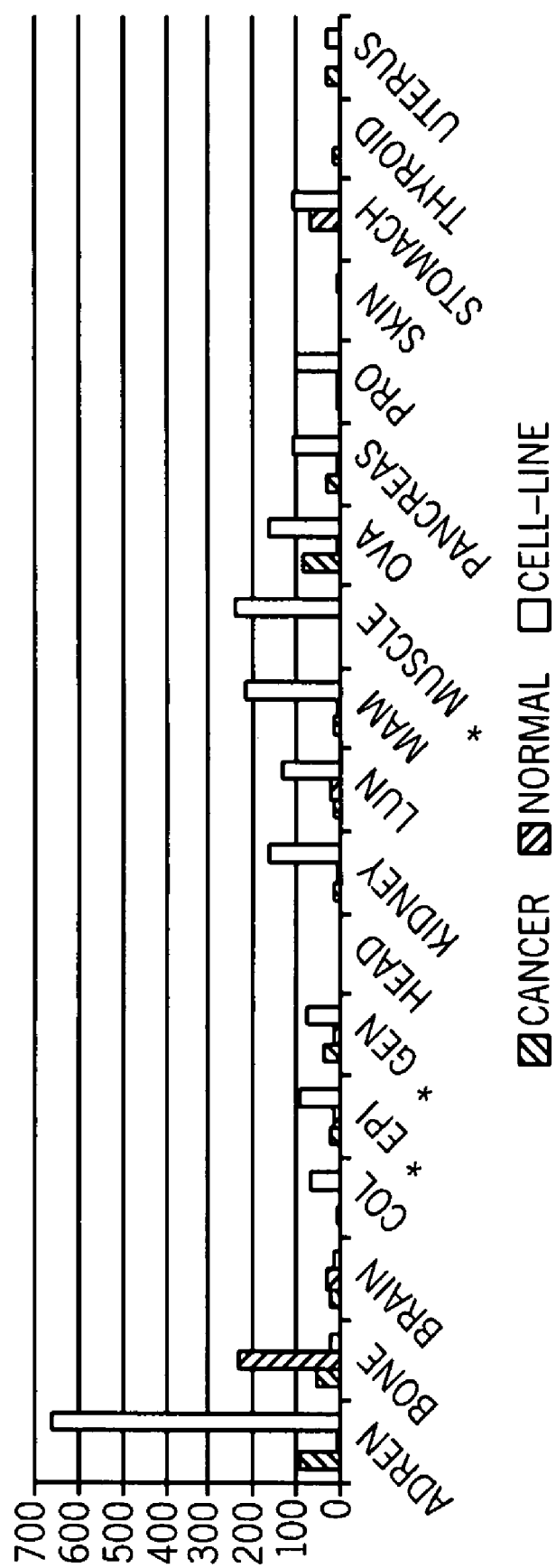
FIG. 76 is a histogram showing Cancer and cell-line vs. normal tissue expression for Cluster H53626, demonstrating overexpression in epithelial malignant tumors, a mixture of malignant tumors from different tissues and myosarcoma.

Overall, the following results were obtained as shown with regard to the histograms in FIG. 76 and Table 1295. This cluster is overexpressed (at least at a minimum level) in the following pathological conditions: epithelial malignant tumors, a mixture of malignant tumors from different tissues and myosarcoma.

TABLE 1295

Normal tissue distribution

| Name of Tissue | Number |
| --- | --- |
| adrenal | 4 |
| bone | 233 |
| brain | 33 |
| colon | 0 |
| epithelial | 12 |
| general | 17 |
| head and neck | 0 |
| kidney | 8 |
| lung | 25 |
| breast | 8 |
| muscle | 0 |
| ovary | 7 |
| pancreas | 10 |
| prostate | 8 |
| skin | 0 |
| stomach | 73 |
| Thyroid | 0 |
| uterus | 0 |

TABLE 1296

P values and ratios for expression in cancerous tissue

| Name of Tissue | P1 | P2 | SP1 | R3 | SP2 | R4 |
| --- | --- | --- | --- | --- | --- | --- |
| adrenal | 6.4e−01 | 4.2e−01 | 2.1e−01 | 3.1 | 1.3e−02 | 4.1 |
| bone | 5.8e−01 | 8.1e−01 | 9.8e−01 | 0.3 | 1.0e+00 | 0.3 |
| brain | 2.2e−01 | 2.6e−01 | 8.1e−01 | 0.8 | 8.9e−01 | 0.6 |
| colon | 2.3e−01 | 1.4e−01 | 1.5e+00 | 1.2 | 4.6e−01 | 1.9 |
| epithelial | 8.3e−02 | 4.8e−03 | 6.4e−02 | 1.5 | 6.6e−08 | 4.1 |
| general | 2.4e−03 | 1.5e−05 | 1.1e−03 | 1.6 | 2.0e−12 | 3.1 |
| head and neck | 2.1e−01 | 3.3e−01 | 0.0e+00 | 0.0 | 0.0e+00 | 0.0 |
| kidney | 7.3e−01 | 5.8e−01 | 5.8e−01 | 1.3 | 5.7e−02 | 2.0 |
| lung | 8.3e−01 | 5.5e−01 | 7.9e−01 | 0.8 | 3.2e−02 | 2.1 |
| breast | 6.5e−01 | 2.7e−01 | 6.9e−01 | 1.2 | 7.8e−02 | 1.9 |
| muscle | 1.5e+00 | 2.9e−01 | 1.5e+00 | 1.0 | 3.5e−03 | 4.1 |
| ovary | 6.7e−01 | 5.6e−01 | 1.5e−01 | 1.7 | 7.0e−02 | 2.7 |
| pancreas | 2.3e−01 | 2.0e−01 | 3.9e−01 | 1.9 | 8.2e−02 | 2.3 |
| prostate | 9.0e−01 | 9.0e−01 | 6.7e−01 | 1.1 | 1.8e−01 | 1.9 |
| skin | 1.5e+00 | 4.4e−01 | 1.5e+00 | 1.0 | 6.4e−01 | 1.6 |
| stomach | 9.0e−01 | 3.4e−01 | 1.0e+00 | 0.3 | 6.1e−01 | 0.9 |
| Thyroid | 2.4e−01 | 2.4e−01 | 1.5e+00 | 1.1 | 1.5e+00 | 1.1 |
| uterus | 2.1e−01 | 2.4e−01 | 2.9e−01 | 2.5 | 2.6e−01 | 2.2 |

As noted above, contig H53626 features 2 transcript(s), which were listed in Table 1292 above. A description of each variant protein according to the present invention is now provided.

Variant protein H53626_PEA_1_P4 (SEQ ID NO:324) according to the present invention has an amino acid sequence as given at the end of the application; it is encoded by transcript(s) H53626_PEA_1_T15 (SEQ ID NO:16). The alignment to the wild type protein is given at the end of the application. A brief description of the relationship of the variant protein according to the present invention to the wild type protein is as follows:

Comparison report between H53626_PEA_1_P4 (SEQ ID NO:324) and wild type Q8N441 (SEQ ID NO:1699):

1. An isolated chimeric polypeptide encoding for H53626_PEA_1_P4 (SEQ ID NO:324), comprising a first amino acid sequence being at least 90% homologous to MTPSPLLLLLLPPLLLGAFPPAAAARGPPKMADKVV-PRQVARLGRTVRLQCPVEGDPPPLTMWTKDGRTI HSGWSRFRVLPQGLKVKQVEREDAGVYVCKAT-NG-FGSLSVNYTLVVLDDISPGKESLGPDSSSGGQEDPA SQQWARPRFTQPSKMRRRVIARPVGSSVRLKCV-ASGHPRPDITWMKDDQALTRPEAAEPRKKKWT-LSLK NLRPEDSGKYTCRVSNRAGAINATYKVD-VIQRTRSKPVLTGTHPVNTTVDFGGTTSFQCKVR-SDVKPVIQ WLKRVEYGAEGRHNSTIDVGGQKFVV-LPTGDVWSRPDGSYLNKLLITRARQDDAGMYICL-GANTMGYSF RSAFLTVLP corresponding to amino acids 1-357 of Q8N441 (SEQ ID NO:1699), which also corresponds to amino acids 1-357 of H53626_PEA_1_P4 (SEQ ID NO:324), second amino acid sequence being at least 70%, optionally at least 80%, preferably at least 85%, more preferably at least 90% and most preferably at least 95% homologous to a polypeptide having the sequence GARLPRHAT-PCWCPDPPPGPGVPPTGWGPTLPSRAVLARSSAEGG-QPRGTVSTAPGMGLGCSPGLCVGVP LPTSFPLALA (SEQ ID NO: 1775) corresponding to amino acids 358-437 of H53626_PEA_1_P4 (SEQ ID NO:324), and a third amino acid sequence being at least 90% homologous to DPKPPG-PPVASSSSATSLPWPVVIGIPAGAVFILGTLLLWLC-QAQKKPCTPAPAPPLPGHRPPGTARDRSGD KDLPS-LAALSAGPGVGLCEEHGSPAAPQHLLGPGPVAGPKL-YPKLYTDIHTHTHTHSHTHSHVEGKVHQH IHYQC corresponding to amino acids 358-504 of Q8N441 (SEQ ID NO:1699), which also corresponds to amino acids 438-584 of H53626_PEA_1_P4 (SEQ ID NO:324), wherein said first, second and third amino acid sequences are contiguous and in a sequential order.

2. An isolated polypeptide encoding for an edge portion of H53626_PEA_1_P4 (SEQ ID NO:324), comprising an amino acid sequence being at least 70%, optionally at least about 80%, preferably at least about 85%, more preferably at least about 90% and most preferably at least about 95% homologous to the sequence encoding for GARLPRHAT-PCWCPDPPPGPGVPPTGWGPTLPSRAVLARSSAEG-GQPRGTVSTAPGMGLGCSPGLCVGVP LPTSFPLALA (SEQ ID NO: 1775), corresponding to H53626_PEA_1_P4 (SEQ ID NO:324).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein H53626_PEA_1_P4 (SEQ ID NO:324) also has the following non-silent SNPs (Single Nucleotide Polymorphisms) as listed in Table 1297, (given according to their position(s) on the amino acid sequence, with the alternative amino acid(s) listed; the last column indicates whether the SNP is known or not; the presence of known SNPs in variant protein H53626_PEA_1_P4 (SEQ ID NO:324) sequence provides support for the deduced sequence of this variant protein according to the present invention).

TABLE 1297

| | Amino acid mutations | |
|---|---|---|
| SNP position(s) on amino acid sequence | Alternative amino acid(s) | Previously known SNP? |
| 193 | R -> L | Yes |
| 300 | G -> | No |
| 319 | Y -> H | No |
| 442 | P -> Q | Yes |
| 504 | R -> L | Yes |
| 521 | G -> | No |
| 544 | P -> L | Yes |
| 573 | E -> G | No |

Variant protein H53626_PEA_1_P4 (SEQ ID NO:324) is encoded by the following transcript(s): H53626_PEA_1_T55 (SEQ ID NO:16), for which the sequence(s) is/are given at the end of the application. The coding portion of transcript H53626_PEA_1_T15 (SEQ ID NO:16) is shown in bold; this coding portion starts at position 17 and ends at position 1771. The transcript also has the following SNPs as listed in Table 1298 (given according to their position on the nucleotide sequence, with the alternative nucleic acid listed; the last column indicates whether the SNP is known or not; the presence of known SNPs in variant protein H53626_PEA_1_P4 (SEQ ID NO:324) sequence provides support for the deduced sequence of this variant protein according to the present invention).

TABLE 1298

| | Nucleic acid SNPs | |
|---|---|---|
| SNP position on nucleotide sequence | Alternative nucleic acid | Previously known SNP? |
| 76 | G -> A | Yes |
| 340 | G -> T | No |
| 1647 | C -> T | Yes |
| 1734 | A -> G | No |
| 1797 | G -> | No |
| 1948 | A -> G | Yes |
| 2193 | C -> T | Yes |
| 2308 | C -> T | Yes |
| 2333 | C -> G | Yes |
| 2648 | C -> T | Yes |
| 2649 | G -> A | Yes |
| 2765 | C -> T | Yes |
| 594 | G -> T | Yes |
| 2972 | G -> A | Yes |
| 3027 | C -> G | Yes |
| 907 | T -> C | Yes |
| 916 | C -> | No |
| 971 | T -> C | No |
| 1135 | G -> A | Yes |
| 1341 | C -> A | Yes |
| 1527 | G -> T | Yes |
| 1579 | C -> | No |

Variant protein H53626_PEA_1_P5 (SEQ ID NO:325) according to the present invention has an amino acid sequence as given at the end of the application; it is encoded by transcript(s) H53626_PEA_1_T16 (SEQ ID NO:17). The alignment to the wild type protein is given at the end of the application. A brief description of the relationship of the variant protein according to the present invention to the wild type protein is as follows:

Comparison report between H53626_PEA_1_P5 (SEQ ID NO:325) and wild type Q9H4D7 (SEQ ID NO:1700):

1. An isolated chimeric polypeptide encoding for H53626_PEA_1_P5 (SEQ ID NO:325), comprising a first amino acid sequence being at least 90% homologous to MTPSPLLLLLLPPLLLGAFPPAAAARGPPKMADK-VVPRQVARLGRTVRLQCPVEGDPPPLTMWTKDGRTI HSGWSRFRVLPQGLKVKQVEREDAGVYVCKATNG-FGSLSVNYTLVVLDDISPGKESLGPDSSSGGQEDPA SQQWARPRFTQPSKMRRRVIARPVGSSVRLKCVA-SGHPRPDITWMKDDQALTRPEAAEPRKKKWTLSLK NLRPEDSGKYTCRVSNRAGAINATYKVDVIQRTR-SKPVLTGTHPVNTTVDFG-GTTSFQCK corresponding to amino acids 1-269 of Q9H4D7 (SEQ ID NO:1700), which also corresponds to amino acids 1-269 of H53626_PEA_1_P5 (SEQ ID NO:325), and a second amino acid sequence being at least 70%, optionally at least 80%, preferably at least 85%, more preferably at least 90% and most preferably at least 95% homologous to a polypeptide having the sequence TQN-RQGHLWPPRPRPLACRGPWSSASQPALSSSWA-PCSCGFARPRRSRAPPRLPLPCLGTARRGRPATAAE TRTFPRWPPSALALVWGCVRSMGLRQPPSTYWAQA-QLLALSCTPNSTQTSTHTHTHTLTHTHTWRARSTS TSTISARRHRICSGHGGAGQTGRLGGWRTELQTKA-GDPWRGGMASTPGSLCVRHSPWTHTHRHTHYLDA CMHTHARTRAP (SEQ ID NO:1776) corresponding to amino acids 270-490 of H53626_PEA_1_P5 (SEQ ID NO:325), wherein said first and second amino acid sequences are contiguous and in a sequential order.

2. An isolated polypeptide encoding for a tail of H53626_PEA_1_P5 (SEQ ID NO:325), comprising a polypeptide being at least 70%, optionally at least about 80%, preferably at least about 85%, more preferably at least about 90% and most preferably at least about 95% homologous to the sequence TQNRQGHLWPPRPRPLACRGPWSSASQ-PALSSSWAPCSCGFARPRRSRAPPRLPLPCLGTARRG-RPATAAE TRTFPRWPPSALALVWGCVRSMGLRQPP-STYWAQAQLLALSCTPNSTQTSTHTHTHTLTHTH-TWRARSTS TSTISARRHRICSGHGGAGQTGRLGG-WRTELQTKAGDPWRGGMASTPGSLCVRHSPWTHT-HRHTHYLDA CMHTHARTRAP (SEQ ID NO: 1776) in H53626_PEA_1_P5 (SEQ ID NO:325).

Comparison report between H53626_PEA_1_P5 (SEQ ID NO:325) and wild type Q8N441 (SEQ ID NO:1699):

1. An isolated chimeric polypeptide encoding for H53626_PEA_1_P5 (SEQ ID NO:325), comprising a first amino acid sequence being at least 90% homologous to MTPSPLLLLLLPPLLLGAFPPAAAARGPPKMADK-VVPRQVARLGRTVRLQCPVEGDPPPLTMWTKDGRTI HSGWSRFRVLPQGLKVKQVEREDAGVYVCKAT-NGFGSLSVNYTLVVLDDISPGKESLGPDSSSG-GQEDPA SQQWARPRFTQPSKMRRRVIARPVGSS-VRLKCVASGHPRPDITWMKDDQALTRPEAAEPRKK-KWTLSLK NLRPEDSGKYTCRVSNRAGAINATYKVD-VIQRTRSKPVLTGTHPVNTTVDFGGTTSFQCK corresponding to amino acids 1-269 of Q8N441 (SEQ ID NO:1699), which also corresponds to amino acids 1-269 of H53626_PEA_1_P5 (SEQ ID NO:325), and a second amino acid sequence being at least 70%, optionally at least 80%, preferably at least 85%, more preferably at least 90% and most preferably at least 95% homologous to a polypeptide having the sequence TQNRQGHLWPPRPRPLACRGPWS-SASQPALSSSW-APCSCGFARPRRSRAPPRLPLPCLGTARRGRPATAAE TRTFPRWPPSALALVWGCVRSMGLRQPPSTYWAQ-AQLLALSCTPNSTQTSTHTHTHTLTHTHTWRARSTS TSTISARRHRICSGHGGAGQTGRLGGWRTELQTKA-GDPWRGGMASTPGSLCVRHSPWTHTHTHRHTHYL-DA CMHTHARTRAP (SEQ ID NO:1776) corresponding to amino acids 270-490 of H53626_PEA_1_P5 (SEQ ID NO:325), wherein said first and second amino acid sequences are contiguous and in a sequential order.

2. An isolated polypeptide encoding for a tail of H53626_PEA_1_P5 (SEQ ID NO:325), comprising a polypeptide being at least 70%, optionally at least about 80%, preferably at least about 85%, more preferably at least about 90% and most preferably at least about 95% homologous to the sequence TQNRQGHLWPPRPRPLACRGPWSSASQ-PALSSSWAPCSCGFARPRRSRAPPRLPLPCLGTARRG-GPATAAE TRTFPRWPPSALALVWGCVRSMGLRQPP-STYWAQAQLLALSCTPNSTQTSTHTHTHTLTHTHT-WRARSTS TSTISARRHRICSGHGGAGQTGRLGGWR-TELQTKAGDPWRGGMASTPGSLCVRHSPWTHTH-RHTHYLDA CMHTHARTRAP (SEQ ID NO: 1776) in H53626_PEA_1_P5 (SEQ ID NO:325).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53626_PEA_1_P5 (SEQ ID NO:325) also has the following non-silent SNPs (Single Nucleotide Polymorphisms) as listed in Table 1299 (given according to their position(s) on the amino acid sequence, with the alternative amino acid(s) listed; the last column indicates whether the SNP is known or not; the presence of known SNPs in variant protein H53626_PEA_1_P5 (SEQ ID NO:325) sequence provides support for the deduced sequence of this variant protein according to the present invention).

TABLE 1299

Amino acid mutations

| SNP position(s) on amino acid sequence | Alternative amino acid(s) | Previously known SNP? |
|---|---|---|
| 193 | R -> L | Yes |
| 274 | Q -> K | Yes |
| 336 | A -> S | Yes |
| 353 | A -> | No |
| 376 | Q -> * | Yes |
| 405 | R -> G | No |
| 426 | G -> | No |
| 476 | Y -> C | Yes |

Variant protein H53626_PEA_1_P5 (SEQ ID NO:325) is encoded by the following transcript(s): H53626_PEA_1_T16 (SEQ ID NO:17), for which the sequence(s) is/are given at the end of the application. The coding portion of transcript H53626_PEA_1_T16 (SEQ ID NO:17) is shown in bold; this coding portion starts at position 17 and ends at position 1489. The transcript also has the following SNPs as listed in Table 1300 (given according to their position on the nucleotide sequence, with the alternative nucleic acid listed; the last column indicates whether the SNP is known or not; the presence of known SNPs in variant protein H53626_PEA_1_P5 (SEQ ID NO:325) sequence provides support for the deduced sequence of this variant protein according to the present invention).

TABLE 1300

Nucleic acid SNPs

| SNP position on nucleotide sequence | Alternative nucleic acid | Previously known SNP? |
|---|---|---|
| 76 | G -> A | Yes |
| 340 | G -> T | No |
| 1688 | C -> T | Yes |
| 1803 | C -> T | Yes |
| 1828 | C -> G | Yes |
| 2143 | C -> T | Yes |
| 2144 | G -> A | Yes |
| 2260 | C -> T | Yes |
| 2467 | G -> A | Yes |
| 2522 | C -> G | Yes |
| 594 | G -> T | Yes |
| 836 | C -> A | Yes |
| 1022 | G -> T | Yes |
| 1074 | C -> | No |
| 1142 | C -> T | Yes |
| 1229 | A -> G | No |
| 1292 | G -> | No |
| 1443 | A -> G | Yes |

As noted above, cluster H53626 features 20 segment(s), which were listed in Table 1293 above and for which the sequence(s) are given at the end of the application. These segment(s) are portions of nucleic acid sequence(s) which are described herein separately because they are of particular interest. A description of each segment according to the present invention is now provided.

Segment cluster H53626_PEA_1_node_15 (SEQ ID NO:18) according to the present invention is supported by 25 libraries. The number of libraries was determined as previously described. This segment can be found in the following transcript(s): H53626_PEA_1_T15 (SEQ ID NO:16) and H53626_PEA_1_T16 (SEQ ID NO:17). Table 1301 below describes the starting and ending position of this segment on each transcript.

TABLE 1301

Segment location on transcripts

| Transcript name | Segment starting position | Segment ending position |
|---|---|---|
| H53626_PEA_1_T15 (SEQ ID NO:16) | 96 | 343 |
| H53626_PEA_1_T16 (SEQ ID NO:17) | 96 | 343 |

Segment cluster H53626_PEA_1_node_22 (SEQ ID NO:19) according to the present invention is supported by 42 libraries. The number of libraries was determined as previously described. This segment can be found in the following transcript(s): H53626_PEA_1_T15 (SEQ ID NO:16) and H53626_PEA_1_T16 (SEQ ID NO:17). Table 1302 below describes the starting and ending position of this segment on each transcript.

TABLE 1302

Segment location on transcripts

| Transcript name | Segment starting position | Segment ending position |
|---|---|---|
| H53626_PEA_1_T15 (SEQ ID NO:16) | 450 | 734 |
| H53626_PEA_1_T16 (SEQ ID NO:17) | 450 | 734 |

Segment cluster H53626_PEA_1_node_25 (SEQ ID NO:306) according to the present invention is supported by 41 libraries. The number of libraries was determined as previously described. This segment can be found in the following transcript(s): H53626_PEA_1_T15 (SEQ ID NO:16). Table 1303 below describes the starting and ending position of this segment on each transcript.

TABLE 1303

Segment location on transcripts

| Transcript name | Segment starting position | Segment ending position |
|---|---|---|
| H53626_PEA_1_T15 (SEQ ID NO:16) | 824 | 1088 |

Segment cluster H53626_PEA_1_node_26 (SEQ ID NO:307) according to the present invention is supported by 5 libraries. The number of libraries was determined as previously described. This segment can be found in the following transcript(s): H53626_PEA_1_T15 (SEQ ID NO:16). Table 1304 below describes the starting and ending position of this segment on each transcript.

TABLE 1304

Segment location on transcripts

| Transcript name | Segment starting position | Segment ending position |
|---|---|---|
| H53626_PEA_1_T15 (SEQ ID NO:16) | 1089 | 1328 |

Segment cluster H53626_PEA_1_node_27 (SEQ ID NO:308) according to the present invention is supported by 106 libraries. The number of libraries was determined as previously described. This segment can be found in the following transcript(s): H53626_PEA_1_T15 (SEQ ID NO:16) and H53626_PEA_1_T16 (SEQ ID NO:17). Table 1305 below describes the starting and ending position of this segment on each transcript.

TABLE 1305

Segment location on transcripts

| Transcript name | Segment starting position | Segment ending position |
|---|---|---|
| H53626_PEA_1_T15 (SEQ ID NO:16) | 1329 | 2228 |
| H53626_PEA_1_T16 (SEQ ID NO:17) | 824 | 1723 |

Segment cluster H53626_PEA_1_node_34 (SEQ ID NO:309) according to the present invention is supported by 121 libraries. The number of libraries was determined as previously described. This segment can be found in the following transcript(s): H53626_PEA_1_T15 (SEQ ID NO:16) and H53626_PEA_1_T16 (SEQ ID NO:17). Table 1306 below describes the starting and ending position of this segment on each transcript.

TABLE 1306

Segment location on transcripts

| Transcript name | Segment starting position | Segment ending position |
|---|---|---|
| H53626_PEA_1_T15 (SEQ ID NO:16) | 2507 | 2977 |
| H53626_PEA_1_T16 (SEQ ID NO:17) | 2002 | 2472 |

Segment cluster H53626_PEA_1_node_35 (SEQ ID NO:310) according to the present invention is supported by 85 libraries. The number of libraries was determined as previously described. This segment can be found in the following transcript(s): H53626_PEA_1_T15 (SEQ ID NO:16) and H53626_PEA_1_T16 (SEQ ID NO:17). Table 1307 below describes the starting and ending position of this segment on each transcript.

TABLE 1307

Segment location on transcripts

| Transcript name | Segment starting position | Segment ending position |
|---|---|---|
| H53626_PEA_1_T15 (SEQ ID NO:16) | 2978 | 3148 |
| H53626_PEA_1_T16 (SEQ ID NO:17) | 2473 | 2643 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1308.

TABLE 1308

Oligonucleotides related to this segment

| Oligonucleotide name | Overexpressed in cancers | Chip reference |
|---|---|---|
| NA | | |

Segment cluster H53626_PEA_1_node_36 (SEQ ID NO:311) according to the present invention is supported by 69 libraries. The number of libraries was determined as previously described. This segment can be found in the following transcript(s): H53626_PEA_1_T15 (SEQ ID NO:16) and H53626_PEA_1_T16 (SEQ ID NO:17). Table 1309 below describes the starting and ending position of this segment on each transcript.

TABLE 1309

Segment location on transcripts

| Transcript name | Segment starting position | Segment ending position |
|---|---|---|
| H53626_PEA_1_T15 (SEQ ID NO:16) | 3149 | 3322 |
| H53626_PEA_1_T16 (SEQ ID NO:17) | 2644 | 2817 |

Microarray (chip) data is also available for this segment as follows. As described above with regard to the cluster itself, various oligonucleotides were tested for being differentially expressed in various disease conditions, particularly cancer. The following oligonucleotides were found to hit this segment, shown in Table 1310.

TABLE 1310

Oligonucleotides related to this segment

| Oligonucleotide name | Overexpressed in cancers | Chip reference |
|---|---|---|
| NA | | |

According to an optional embodiment of the present invention, short segments related to the above cluster are also provided. These segments are up to about 120 bp in length, and so are included in a separate description.

Segment cluster H53626_PEA_1_node_11 (SEQ ID NO:312) according to the present invention is supported by 12 libraries. The number of libraries was determined as previously described. This segment can be found in the following transcript(s): H53626_PEA_1_T15 (SEQ ID NO:16) and H53626_PEA_1_T16 (SEQ ID NO:17). Table 1311 below describes the starting and ending position of this segment on each transcript.

TABLE 1311

Segment location on transcripts

| Transcript name | Segment starting position | Segment ending position |
|---|---|---|
| H53626_PEA_1_T15 (SEQ ID NO:16) | 1 | 55 |
| H53626_PEA_1_T16 (SEQ ID NO:17) | 1 | 55 |

Segment cluster H53626_PEA_1_node_12 (SEQ ID NO:313) according to the present invention is supported by 11 libraries. The number of libraries was determined as previously described. This segment can be found in the following transcript(s): H53626_PEA_1_T15 (SEQ ID NO:16) and H53626_PEA_1_T16 (SEQ ID NO:17). Table 1312 below describes the starting and ending position of this segment on each transcript.

TABLE 1312

Segment location on transcripts

| Transcript name | Segment starting position | Segment ending position |
|---|---|---|
| H53626_PEA_1_T15 (SEQ ID NO:16) | 56 | 95 |
| H53626_PEA_1_T16 (SEQ ID NO:17) | 56 | 95 |

Segment cluster H53626_PEA_1_node_16 (SEQ ID NO:314) according to the present invention can be found in the following transcript(s): H53626_PEA_1_T15 (SEQ ID NO:16) and H53626_PEA_1_T16 (SEQ ID NO:17). Table 1313 below describes the starting and ending position of this segment on each transcript.

TABLE 1313

Segment location on transcripts

| Transcript name | Segment starting position | Segment ending position |
|---|---|---|
| H53626_PEA_1_T15 (SEQ ID NO:16) | 344 | 368 |
| H53626_PEA_1_T16 (SEQ ID NO:17) | 344 | 368 |

Segment cluster H53626_PEA_1_node_19 (SEQ ID NO:315) according to the present invention is supported by 25 libraries. The number of libraries was determined as previously described. This segment can be found in the following transcript(s): H53626_PEA_1_T15 (SEQ ID NO:16) and H53626_PEA_1_T16 (SEQ ID NO:17). Table 1314 below describes the starting and ending position of this segment on each transcript.

TABLE 1314

Segment location on transcripts

| Transcript name | Segment starting position | Segment ending position |
|---|---|---|
| H53626_PEA_1_T15 (SEQ ID NO:16) | 369 | 419 |
| H53626_PEA_1_T16 (SEQ ID NO:17) | 369 | 419 |

Segment cluster H53626_PEA_1_node_20 (SEQ ID NO:316) according to the present invention is supported by 27 libraries. The number of libraries was determined as previously described. This segment can be found in the following transcript(s): H53626_PEA_1_T15 (SEQ ID NO:16) and H53626_PEA_1_T16 (SEQ ID NO:17). Table 1315 below describes the starting and ending position of this segment on each transcript.

TABLE 1315

Segment location on transcripts

| Transcript name | Segment starting position | Segment ending position |
|---|---|---|
| H53626_PEA_1_T15 (SEQ ID NO:16) | 420 | 449 |
| H53626_PEA_1_T16 (SEQ ID NO:17) | 420 | 449 |

Segment cluster H53626_PEA_1_node_24 (SEQ ID NO:317) according to the present invention is supported by 34 libraries. The number of libraries was determined as previously described. This segment can be found in the following transcript(s): H53626_PEA_1_T15 (SEQ ID NO:16) and H53626_PEA_1_T16 (SEQ ID NO:17). Table 1316 below describes the starting and ending position of this segment on each transcript.

TABLE 1316

Segment location on transcripts

| Transcript name | Segment starting position | Segment ending position |
|---|---|---|
| H53626_PEA_1_T15 (SEQ ID NO:16) | 735 | 823 |
| H53626_PEA_1_T16 (SEQ ID NO:17) | 735 | 823 |

Segment cluster H53626_PEA_1_node_28 (SEQ ID NO:318) according to the present invention is supported by 66 libraries. The number of libraries was determined as previously described. This segment can be found in the following transcript(s): H53626_PEA_1_T15 (SEQ ID NO:16) and H53626_PEA_1_T16 (SEQ ID NO:17). Table 1317 below describes the starting and ending position of this segment on each transcript.

TABLE 1317

Segment location on transcripts

| Transcript name | Segment starting position | Segment ending position |
|---|---|---|
| H53626_PEA_1_T15 (SEQ ID NO:16) | 2229 | 2306 |
| H53626_PEA_1_T16 (SEQ ID NO:17) | 1724 | 1801 |

Segment cluster H53626_PEA_1_node_29 (SEQ ID NO:319) according to the present invention is supported by 73 libraries. The number of libraries was determined as previously described. This segment can be found in the following transcript(s): H53626_PEA_1_T15 (SEQ ID NO:16) and H53626_PEA_1_T16 (SEQ ID NO:17). Table 1318 below describes the starting and ending position of this segment on each transcript.

TABLE 1318

Segment location on transcripts

| Transcript name | Segment starting position | Segment ending position |
|---|---|---|
| H53626_PEA_1_T15 (SEQ ID NO:16) | 2307 | 2396 |
| H53626_PEA_1_T16 (SEQ ID NO:17) | 1802 | 1891 |

Segment cluster H53626_PEA_1_node_30 (SEQ ID NO:320) according to the present invention is supported by 71 libraries. The number of libraries was determined as previously described. This segment can be found in the following transcript(s): H53626_PEA_1_T15 (SEQ ID NO:16) and H53626_PEA_1_T16 (SEQ ID NO:17). Table 1319 below describes the starting and ending position of this segment on each transcript.

TABLE 1319

Segment location on transcripts

| Transcript name | Segment starting position | Segment ending position |
|---|---|---|
| H53626_PEA_1_T15 (SEQ ID NO:16) | 2397 | 2442 |
| H53626_PEA_1_T16 (SEQ ID NO:17) | 1892 | 1937 |

Segment cluster H53626_PEA_1_node_31 (SEQ ID NO:321) according to the present invention is supported by 67 libraries. The number of libraries was determined as previously described. This segment can be found in the following transcript(s): H53626_PEA_1_T15 (SEQ ID NO:16) and H53626_PEA_1_T16 (SEQ ID NO:17). Table 1320 below describes the starting and ending position of this segment on each transcript.

TABLE 1320

Segment location on transcripts

| Transcript name | Segment starting position | Segment ending position |
|---|---|---|
| H53626_PEA_1_T15 (SEQ ID NO:16) | 2443 | 2469 |
| H53626_PEA_1_T16 (SEQ ID NO:17) | 1938 | 1964 |

Segment cluster H53626_PEA_1_node_32 (SEQ ID NO:322) according to the present invention is supported by 65 libraries. The number of libraries was determined as previously described. This segment can be found in the following transcript(s): H53626_PEA_1_T15 (SEQ ID NO:16) and H53626_PEA_1_T16 (SEQ ID NO:17). Table 1321 below describes the starting and ending position of this segment on each transcript.

TABLE 1321

Segment location on transcripts

| Transcript name | Segment starting position | Segment ending position |
|---|---|---|
| H53626_PEA_1_T15 (SEQ ID NO:16) | 2470 | 2498 |
| H53626_PEA_1_T16 (SEQ ID NO:17) | 1965 | 1993 |

Segment cluster H53626_PEA_1_node_33 (SEQ ID NO:323) according to the present invention can be found in the following transcript(s): H53626_PEA_1_T15 (SEQ ID NO:16) and H53626_PEA_1_T16 (SEQ ID NO:17). Table 1322 below describes the starting and ending position of this segment on each transcript.

TABLE 1322

Segment location on transcripts

| Transcript name | Segment starting position | Segment ending position |
|---|---|---|
| H53626_PEA_1_T15 (SEQ ID NO:16) | 2499 | 2506 |
| H53626_PEA_1_T16 (SEQ ID NO:17) | 1994 | 2001 |

Variant protein alignment to the previously known protein:

Sequence name: /tmp/K1Mec2ReKO/eg1EUS2AXY: Q8N441 (SEQ ID NO:1699)

Sequence documentation:

Alignment of: H53626_PEA_1_P4 (SEQ ID NO:324) x Q8N441 (SEQ ID NO:1699)

Alignment segment 1/1:

| | |
|---|---|
| Quality: 4882.00 | Escore: 0 |
| Matching length: 504 | Total length: 584 |
| Matching Percent Similarity: 100.00 | Matching Percent Identity: 100.00 |
| Total Percent Similarity: 86.30 | Total Percent Identity: 86.30 |
| Gaps: 1 | |

```
  1 MTPSPLLLLLLPPLLLGAFPPAAAARGPPKMADKVVPRQVARLGRTVRLQ   50
    ||||||||||||||||||||||||||||||||||||||||||||||||||
  1 MTPSPLLLLLLPPLLLGAFPPAAAARGPPKMADKVVPRQVARLGRTVRLQ   50

51 CPVEGDPPPLTMWTKDGRTIHSGWSRFRVLPQGLKVKQVEREDAGVYVCK  100
    |||||||||||||||||||||||||||||||||||||||||||||||||
 51 CPVEGDPPPLTMWTKDGRTIHSGWSRFRVLPQGLKVKQVEREDAGVYVCK  100

101 ATNGFGSLSVNYTLVVLDDISPGKESLGPDSSSGGQEDPASQQWARPRFT  150
    |||||||||||||||||||||||||||||||||||||||||||||||||
101 ATNGFGSLSVNYTLVVLDDISPGKESLGPDSSSGGQEDPASQQWARPRFT  150

151 QPSKMRRRVIARPVGSSVRLKCVASGHPRPDITWMKDDQALTRPEAAEPR  200
    |||||||||||||||||||||||||||||||||||||||||||||||||
151 QPSKMRRRVIARPVGSSVRLKCVASGHPRPDITWMKDDQALTRPEAAEPR  200

201 KKKWTLSLKNLRPEDSGKYTCRVSNRAGAINATYKVDVIQRTRSKPVLTG  250
    |||||||||||||||||||||||||||||||||||||||||||||||||
201 KKKWTLSLKNLRPEDSGKYTCRVSNRAGAINATYKVDVIQRTRSKPVLTG  250

251 THPVNTTVDFGGTTSFQCKVRSDVKPVIQWLKRVEYGAEGRHNSTIDVGG  300
    |||||||||||||||||||||||||||||||||||||||||||||||||
251 THPVNTTVDFGGTTSFQCKVRSDVKPVIQWLKRVEYGAEGRHNSTIDVGG  300

301 QKFVVLPTGDVWSRPDGSYLNKLLITRARQDDAGMYICLGANTMGYSFRS  350
    |||||||||||||||||||||||||||||||||||||||||||||||||
301 QKFVVLPTGDVWSRPDGSYLNKLLITRARQDDAGMYICLGANTMGYSFRS  350

351 AFLTVLPGARLPRHATPCWCPDPPPGPGVPPTGWGPTLPSRAVLARSSAE  400
    |||||||
351 AFLTVLP.........................................  357

401 GGQPRGTVSTAPGMGLGCSPGLCVGVPLPTSFPLALADPKPPGPPVASSS  450
                                      |||||||||||||||||
358 .................................DPKPPGPPVASSS  370

451 SATSLPWPVVIGIPAGAVFILGTLLLWLCQAQKKPCTPAPAPPLPGHRPP  500
    |||||||||||||||||||||||||||||||||||||||||||||||||
371 SATSLPWPVVIGIPAGAVFILGTLLLWLCQAQKKPCTPAPAPPLPGHRPP  420

501 GTARDRSGDKDLPSLAALSAGPGVGLCEEHGSPAAPQHLLGPGPVAGPKL  550
    |||||||||||||||||||||||||||||||||||||||||||||||||
421 GTARDRSGDKDLPSLAALSAGPGVGLCEEHGSPAAPQHLLGPGPVAGPKL  470

551 YPKLYTDIHTHTHTHSHTHSHVEGKVHQIHYQC                 584
    ||||||||||||||||||||||||||||||||
471 YPKLYTDIHTHTHTHSHTHSHVEGKVHQIHYQC                 504
```

Alignment:
Sequence name: /tmp/oSUZaRW3WK/oSh3fN5Zt0: Q9H4D7 (SEQ ID NO:1700)
Sequence documentation:
Alignment of: H53626_PEA_1_P5 (SEQ ID NO:325) x Q9H4D7 (SEQ ID NO:1700)

| | |
|---|---|
| Quality: 2644.00 | Escore: 0 |
| Matching length: 269 | Total length: 269 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1  MTPSPLLLLLLPPLLLGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCK                                 269
     |||||||||||||||||||
251  THPVNTTVDFGGTTSFQCK                                 269
```

Sequence name: /tmp/oSUZaRW3WK/oSh3fN5Zt0: Q8N441 (SEQ ID NO:1699)

Sequence documentation:

Alignment of: H53626_PEA__1_P5 (SEQ ID NO:325) x Q8N441 (SEQ ID NO:1699)

Alignment segment 1/1:

| | |
|---|---|
| Quality: 2644.00 | Escore: 0 |
| Matching length: 269 | Total length: 269 |
| Matching Percent Similarity: 100.00 | Matching Percent Identity: 100.00 |
| Total Percent Similarity: 100.00 | Total Percent Identity: 100.00 |
| Gaps: 0 | |

Alignment:

```
  1  MTPSPLLLLLLPPLLLGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250
```

```
251  THPVNTTVDFGGTTSFQCK                269
     |||||||||||||||||||
251  THPVNTTVDFGGTTSFQCK                269
```

Expression of *Homo Sapiens* Fibroblast Growth Factor Receptor-Like 1 (FGFRL1) H53626 Transcripts, which are Detectable by Amplicon as Depicted in Sequence Name H53626junc24-27F1R3 (SEQ ID NO:1690) in Normal and Cancerous Lung Tissues Expression of *Homo sapiens* fibroblast growth factor receptor-like 1 (FGFRL1) transcripts detectable by or according to junc24-27, H53626 junc24-27F1R3 amplicon (SEQ ID NO:1690) and H53626 junc24-27F1 (SEQ ID NO: 1688) and H53626 junc24-27R3 (SEQ ID NO: 1689) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 74:
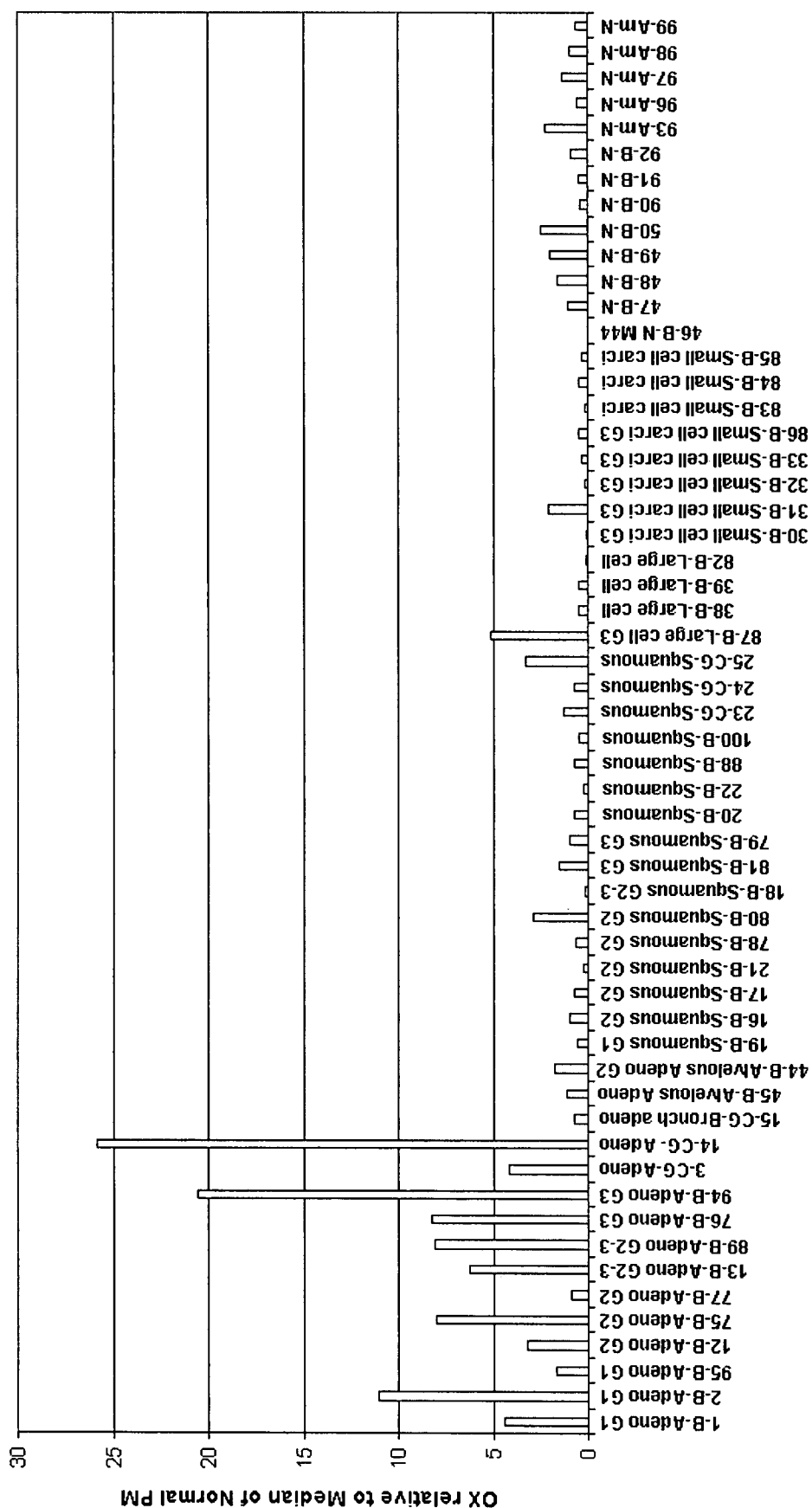
FIG. 74 is a histogram showing over expression of the Homo sapiens fibroblast growth factor receptor-like 1 (FGFRL1) H53626 transcripts, which are detectable by amplicon as depicted in sequence name H53626 junc24-27FIR3 (SEQ ID NO:1690) in cancerous lung samples relative to the normal samples.

FIG. 74 is a histogram showing over expression of the above-indicated *Homo sapiens* fibroblast growth factor receptor-like 1 (FGFRL1) transcripts in cancerous lung samples relative to the normal samples.

As is evident from FIG. 74, the expression of *Homo sapiens* fibroblast growth factor receptor-like 1 (FGFRL1) transcripts detectable by the above amplicon(s) was higher in several cancer samples than in the non-cancerous samples (Sample Nos. 46-50, 90-93, 96-99 Table 2). Notably an overexpression of at least 5 fold was found in 7 out of 15 adenocarcinoma samples.

Primer pairs are also optionally and preferably encompassed within the present invention; for example, for the above experiment, the following primer pair was used as a non-limiting illustrative example only of a suitable primer pair: H53626 junc24-27F1 forward primer (SEQ ID NO: 1688); and H53626 junc24-27R3 reverse primer (SEQ ID NO: 1689).

The present invention also preferably encompasses any amplicon obtained through the use of any suitable primer pair; for example, for the above experiment, the following amplicon was obtained as a non-limiting illustrative example only of a suitable amplicon: H53626 junc24-27F1R3 (SEQ ID NO:1690).

Forward primer (SEQ ID NO: 1688): GTCCTTCCAGTG-CAAGACCCA

Reverse primer (SEQ ID NO: 1689): TGGGCCTG-GCAAAGCC

Amplicon (SEQ ID NO: 1690): GTCCTTCCAGTGCAA-GACCCAAAACCGCCAGGGCCACCTGTGGCCTCCT-CGTCCTCGGCCACTAGCCT GCCGTGGCCCGTGGT-CATCGGCATCCCAGCCGGCGCTGTCTTCATCCTGG-GCACCCTGCTCCTGTGGC TTTGCCAGGCCCA Expression of *Homo Sapiens* Fibroblast Growth Factor Receptor-Like 1 (FGFRL1) H53626 Transcripts, which are Detectable by Amplicon as Depicted in Sequence Name H53626 seg25 (SEQ ID NO:1693) in Normal and Cancerous lung Tissues Expression of *Homo sapiens* fibroblast growth factor receptor-like 1 (FGFRL1) transcripts detectable by or according to seg25, H53626 seg25 amplicon (SEQ ID NO: 1693) and H53626 seg25F (SEQ ID NO: 1691) and H53626 seg25R (SEQ ID NO: 1692) primers was measured by real time PCR. In parallel the expression of four housekeeping genes—PBGD (GenBank Accession No. BC019323 (SEQ ID NO:1713); amplicon—PBGD-amplicon, SEQ ID NO:334), HPRT1 (GenBank Accession No. NM_000194 (SEQ ID NO:1714); amplicon—HPRT1-amplicon, SEQ ID NO:1297), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331), was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above), to obtain a value of fold up-regulation for each sample relative to median of the normal PM samples.

Figure 75:
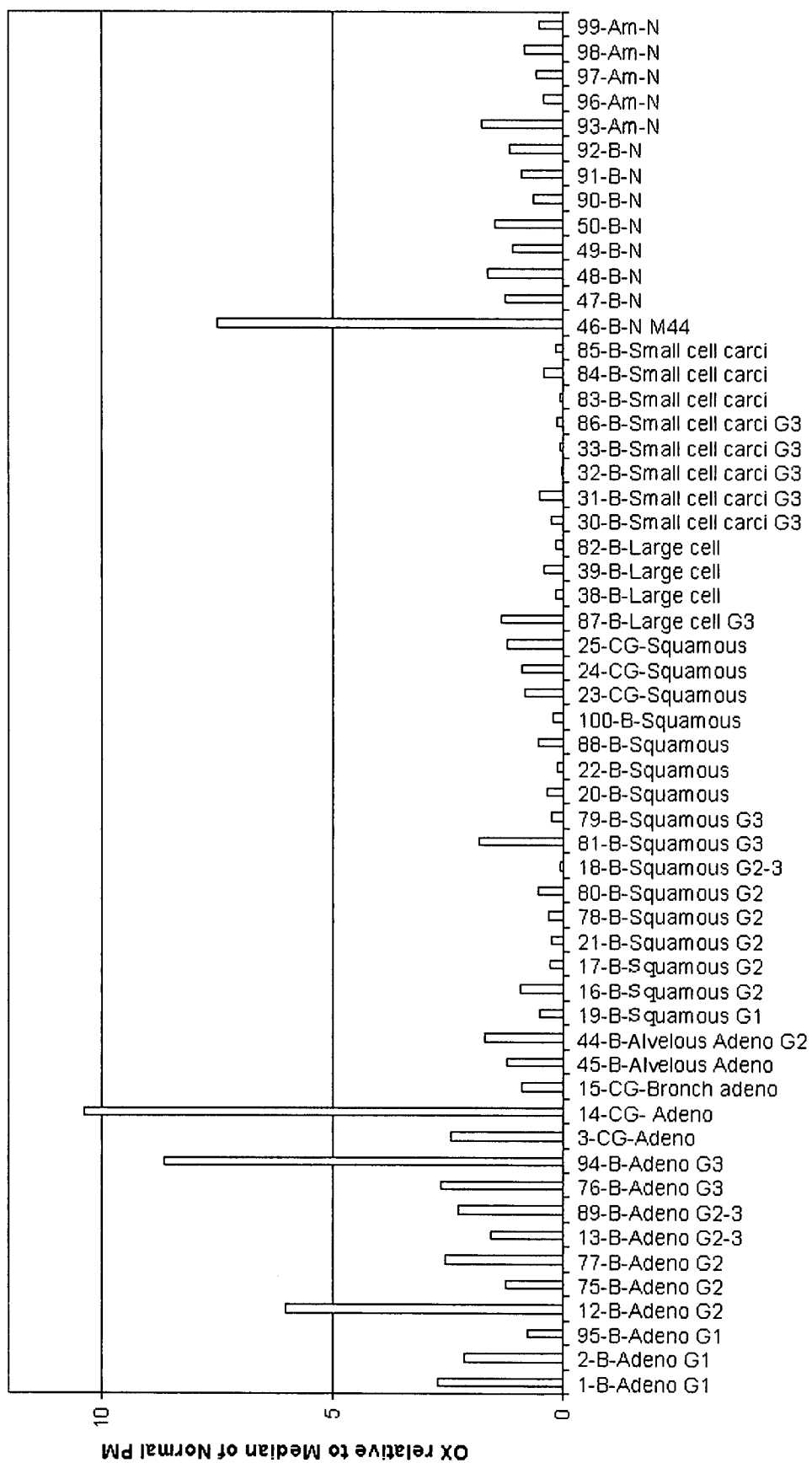
FIG. 75 is a histogram showing the expression of the Homo sapiens fibroblast growth factor receptor-like 1 (FGFRL1) H53626 transcripts, which are detectable by amplicon as depicted in sequence name H53626 seg25 (SEQ ID NO:1693) in cancerous lung samples relative to the normal samples.

As is evident from FIG. 75, the expression of *Homo sapiens* fibroblast growth factor receptor-like 1 (FGFRL1) transcripts detectable by the above amplicon(s) was higher in a few cancer samples than in the non-cancerous samples (Sample Nos. 46-50, 90-93, 96-99 Table 2). Notably an overexpression of at least 5 fold was found in 3 out of 15 adenocarcinoma samples.

Primer pairs are also optionally and preferably encompassed within the present invention; for example, for the above experiment, the following primer pair was used as a non-limiting illustrative example only of a suitable primer pair: H53626 seg25F forward primer (SEQ ID NO: 1691); and H53626 seg25R reverse primer (SEQ ID NO: 1692).

The present invention also preferably encompasses any amplicon obtained through the use of any suitable primer pair; for example, for the above experiment, the following amplicon was obtained as a non-limiting illustrative example only of a suitable amplicon: H53626 seg25 (SEQ ID NO:1693).

Forward primer (SEQ ID NO: 1691); CCGACGGCTC-CTACCTCAA

Reverse primer (SEQ ID NO: 1692): GGAAGCTGTAGC-CCATGGTGT

Amplicon (SEQ ID NO: 1693): CCGACGGCTCCTACCT-CAATAAGCTGCTCATCACCCGTGCCCGC-

CAGGACGATGCGGGCATGTACATC TGCCTTGGCGC-
CAACACCATGGGCTACAGCTTCC

Expression of *Homo Sapiens* Fibroblast Growth
Factor Receptor-Like 1 (FGFRL1) H53626
Transcripts, which are Detectable by Amplicon as
Depicted in Sequence Name H53626 seg25 (SEQ ID
NO:1693) in Different Normal Tissues Expression of *Homo sapiens* fibroblast growth factor receptor-like 1 (FGFRL1) transcripts detectable by or according to H53626 seg25 amplicon (SEQ ID NO: 1693) and H53626 seg25F (SEQ ID NO: 1691) and H53626 seg25R (SEQ ID NO: 1692) was measured by real time PCR. In parallel the expression of four housekeeping genes: RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633), UBC (GenBank Accession No. BC000449 (SEQ ID NO:1711); amplicon-Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 3 above), to obtain a value of relative expression of each sample relative to median of the lung samples.

Forward primer (SEQ ID NO: 1691); CCGACGGCTC-
CTACCTCAA

Reverse primer (SEQ ID NO: 1692): GGAAGCTGTAGC-
CCATGGTGT

Figure 77:
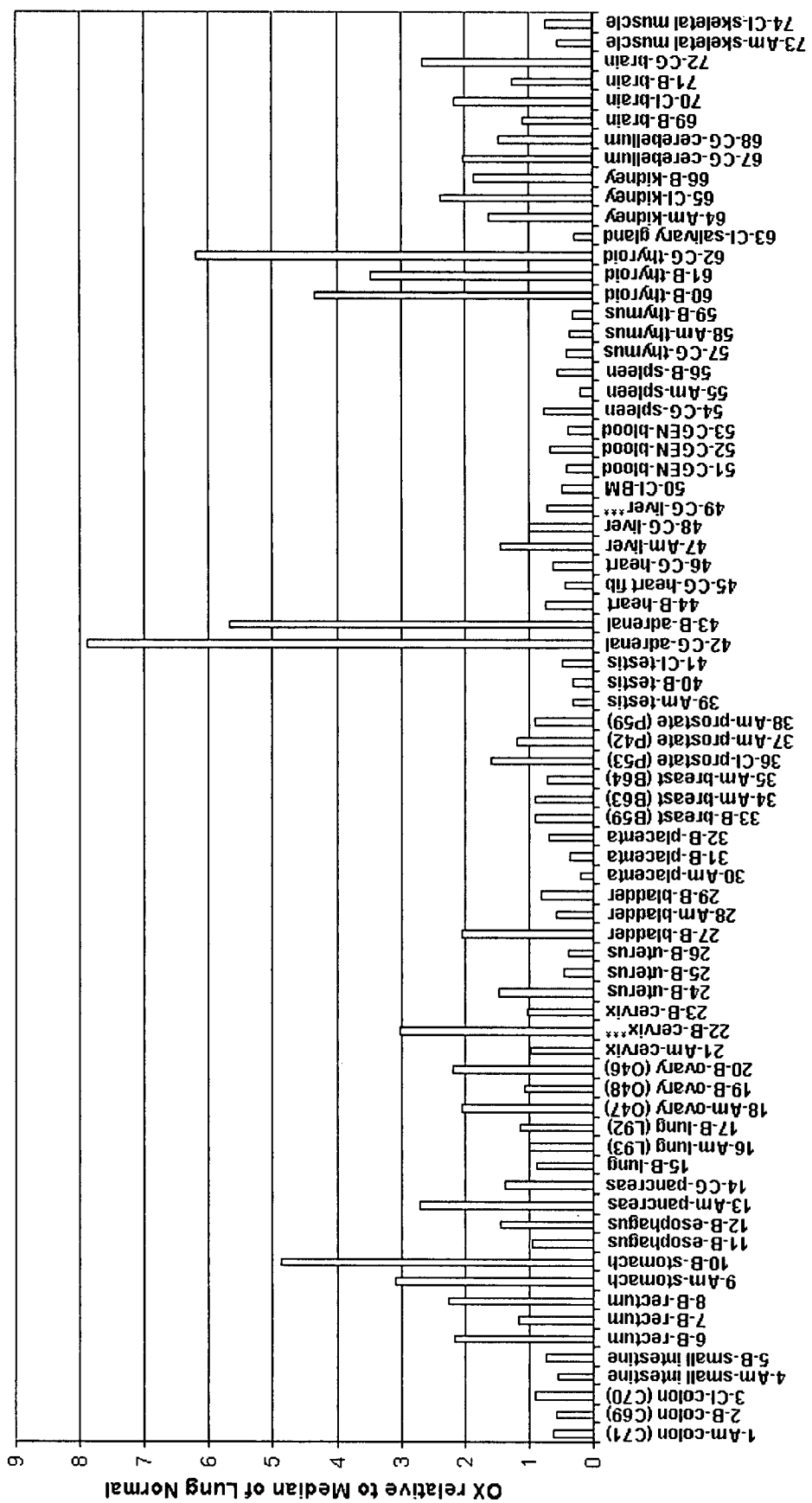
FIG. 77 is a histogram showing the expression of Homo sapiens fibroblast growth factor receptor-like 1 (FGFRL1) H53626 transcripts, which are detectable by amplicon as depicted in sequence name H53626 seg25 (SEQ ID NO:1693) in different normal tissues.

Amplicon (SEQ ID NO: 1693): CCGACGGCTCCTACCT-
CAATAAGCTGCTCATCACCCGTGCCCGC-
CAGGACGATGCGGGCATGTACATC TGCCTTGGCGC-
CAACACCATGGGCTACAGCTTCC The results are demonstrated in FIG. 77, showing the expression of *Homo sapiens* fibroblast growth factor receptor-like 1 (FGFRL1) H53626 transcripts, which are detectable by amplicon as depicted in sequence name H53626 seg25 (SEQ ID NO:1693) in different normal tissues.

Expression of *Homo Sapiens* Fibroblast Growth
Factor Receptor-Like 1 (FGFRL1) H53626
Transcripts which are Detectable by Amplicon as
Depicted in Sequence Name H53626
junc24-27F1R3 (SEQ ID NO: 1690) in Different
normal Tissues Expression of *Homo sapiens* fibroblast growth factor receptor-like 1 (FGFRL1) transcripts detectable by or according to H53626junc24-27F1R3 amplicon (SEQ ID NO: 1690) and H53626 junc24-27F1 (SEQ ID NO: 1688) and H53626 junc24-27R3 (SEQ ID NO: 1689) was measured by real time PCR. In parallel the expression of four housekeeping genes—RPL19 (GenBank Accession No. NM_000981 (SEQ ID NO:1715); RPL19 amplicon, SEQ ID NO:1630), TATA box (GenBank Accession No. NM_003194 (SEQ ID NO:1716); TATA amplicon, SEQ ID NO:1633; primers SEQ ID NOs 1631 and 1632), UBC (GenBank Accession No. BC000449 (SEQ ID NO:1711); amplicon—Ubiquitin-amplicon, SEQ ID NO:328) and SDHA (GenBank Accession No. NM_004168 (SEQ ID NO:1712); amplicon—SDHA-amplicon, SEQ ID NO:331) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17 Table 3 above), to obtain a value of relative expression of each sample relative to median of the lung samples.

Forward primer (SEQ ID NO: 1688): GTCCTTCCAGTG-
CAAGACCCA

Reverse primer (SEQ ID NO: 1689): TGGGCCTG-
GCAAAGCC

Figure 78:
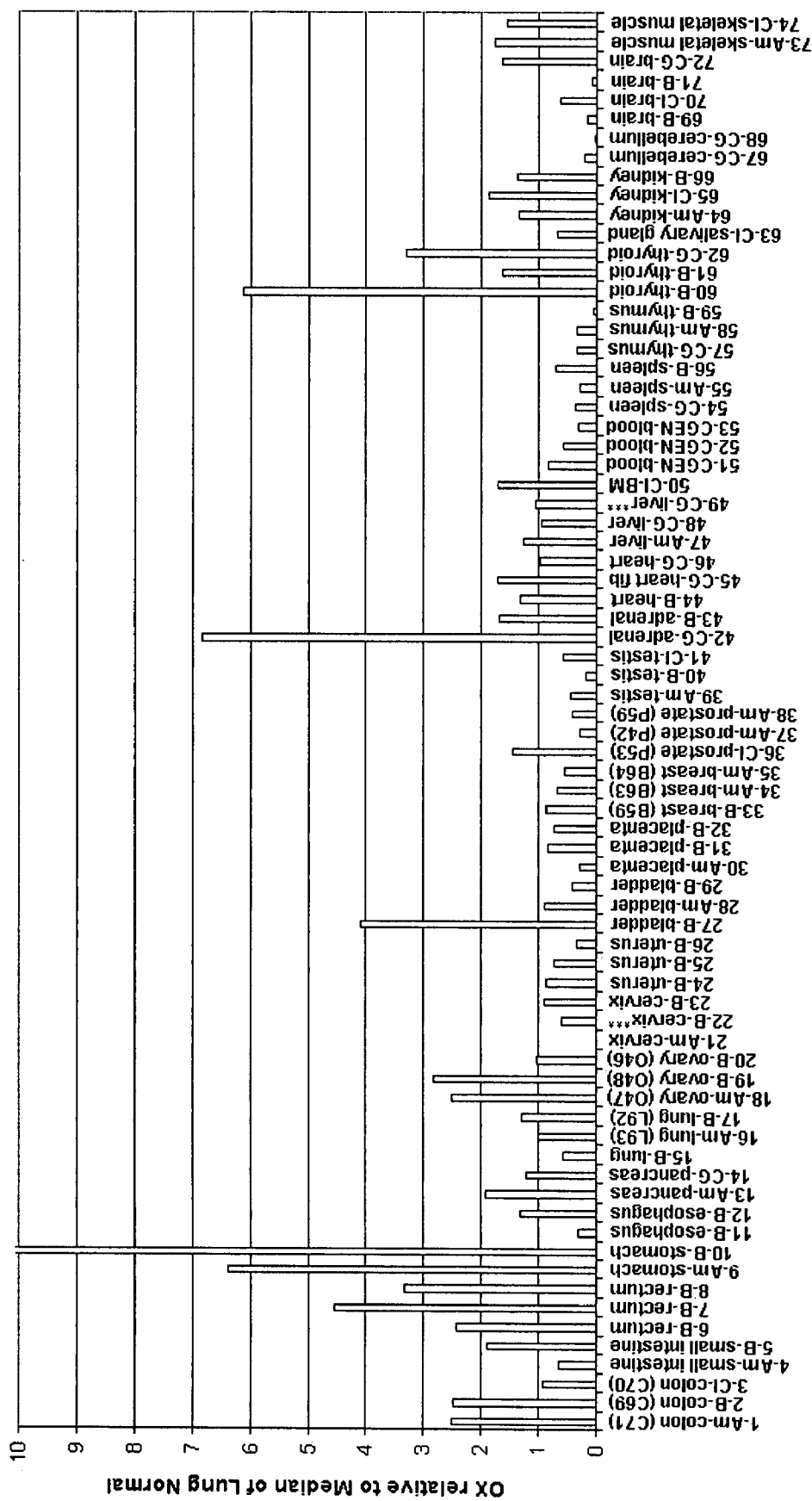
FIG. 78 is a histogram showing the expression of *Homo sapiens* fibroblast growth factor receptor-like 1 (FGFRL1) H53626 transcripts, which are detectable by amplicon as depicted in sequence name H53626junc24-27F1R3 (SEQ ID NO: 1690) in different normal tissues.

Amplicon (SEQ ID NO: 1690): GTCCTTCCAGTGCAA-
GACCCAAAACCGCCAGGGCCACCTGTGGCCTCCT-
CGTCCTCGGCCACTAGCCT GCCGTGGCCCGTGGT-
CATCGGCATCCCAGCCGGCGCTGTCTTCATCCTGG-
GCACCCTGCTCCTGTGGC TTTGCCAGGCCCA The results are demonstrated in FIG. 78, showing the expression of *Homo sapiens* fibroblast growth factor receptor-like 1 (FGFRL1) H53626 transcripts, which are detectable by amplicon as depicted in sequence name H53626junc24-27F1R3 (SEQ ID NO:1690) in different normal tissues.

Expression of Trophinin Associated Protein (Tastin)
[T86235] Transcripts which are Detectable by
Amplicon as Depicted in SEQ ID NO:1480 in
Normal and Cancerous Lung Tissues Expression of trophinin associated protein (tastin) transcripts detectable by SEQ ID NO:1480 (e.g., variant no. 23-2631, 32—represented by SEQ IDs 1485-1488, 1609, 1610) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1480 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 54A:
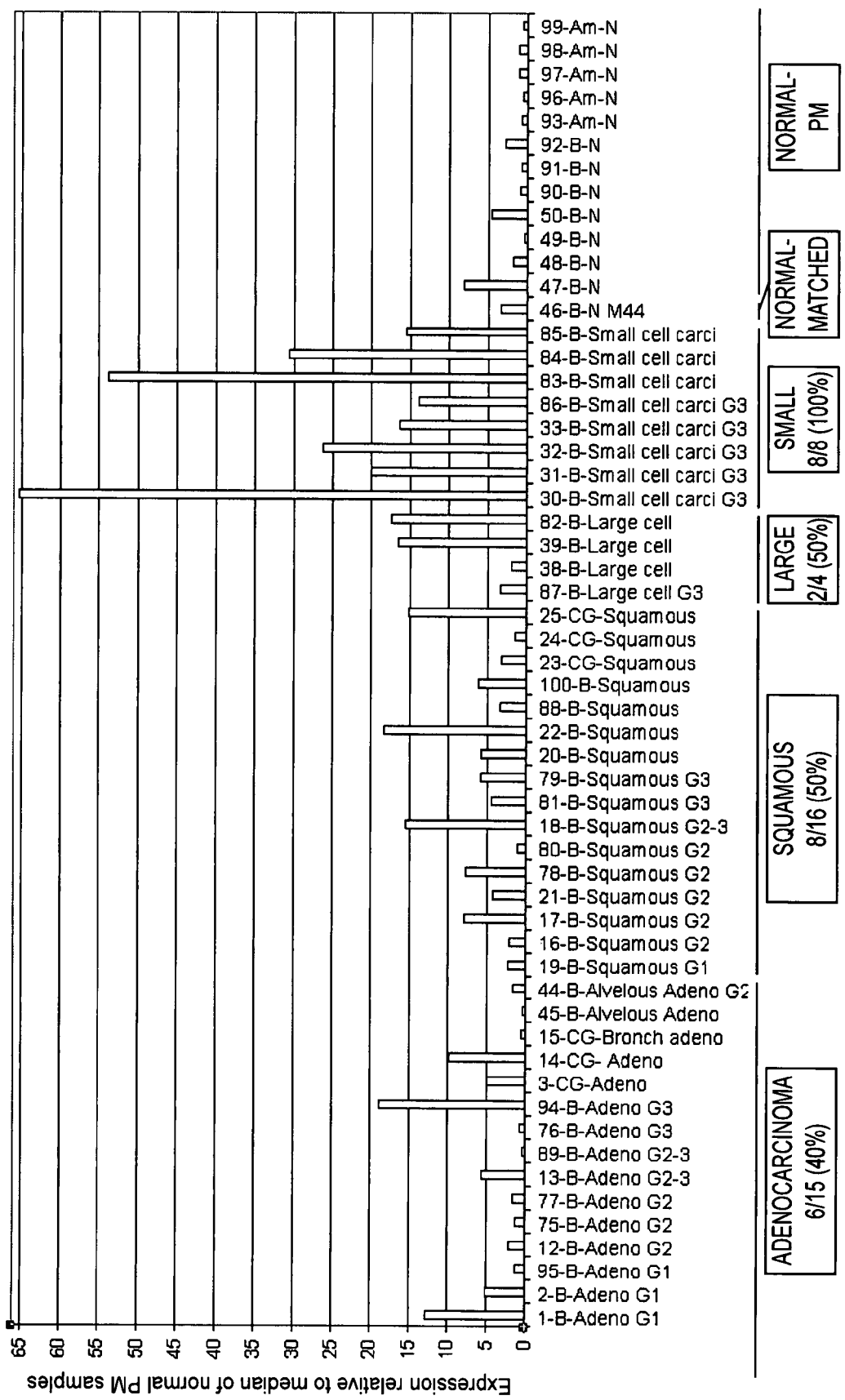
FIG. 54a is a histogram showing the relative expression of trophinin associated protein (tastin)) [T86235] variants (e.g., variant no. 23-26, 31, 32) in normal and tumor derived lung samples as determined by real time PCR using primers for SEQ ID NO:1480.

FIG. 54*a* is a histogram showing over expression of the above-indicated trophinin associated protein (tastin) transcripts in cancerous lung samples relative to the normal samples. The number and percentage of samples that exhibit at least 5 fold over-expression, out of the total number of samples tested is indicated in the bottom.

As is evident from FIG. 54*a*, the expression of trophinin associated protein (tastin) transcripts detectable by SEQ ID NO:1480 in cancer samples was significantly higher than in the non-cancerous samples (Sample Nos. 46-50, 90-93, 96-99 Table 2, "Tissue samples in testing panel"). Notably an over-expression of at least 5 fold was found in 6 out of 15 adenocarcinoma samples, 8 out of 16 squamous cell carcinoma samples, 2 out of 4 large cell carcinoma samples and in 8 out of 8 small cells carcinoma samples.

Statistical analysis was applied to verify the significance of these results, as described below.

The P value for the difference in the expression levels of trophinin associated protein (tastin) transcripts detectable by SEQ ID NO:1480 in lung cancer samples versus the normal lung samples was determined by T test as 1.61E-04.

Threshold of 5 fold overexpression was found to differentiate between cancer and normal samples with P value of 1.49E-02 as checked by exact fisher test. The above values demonstrate statistical significance of the results.

According to the present invention, trophinin associated protein (tastin) is a non-limiting example of a marker for diagnosing lung cancer. The trophinin associated protein (tastin) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to trophinin associated protein (tastin) as previously defined is also encompassed within the present invention. Primer pairs are also optionally and preferably encompassed within the present invention; for example, for the above experiment, the following primer pair was used as a non-limiting illustrative example only of a suitable primer pair: trophinin associated protein (tastin)-TAA-seg 44-forward primer (SEQ ID NO: 1478): AGACTCCAACCCACAGCCC; and trophinin associated protein (tastin)—TAA-seg 44-Reverse primer (SEQ ID NO: 1479): CAGCTCAGCCAACCTTGCA.

The present invention also preferably encompasses any amplicon obtained through the use of any suitable primer pair; for example, for the above experiment, the following amplicon was obtained as a non-limiting illustrative example only of a suitable amplicon: trophinin associated protein (tastin) amplicon, SEQ ID NO: 1480: AGACTCCAACCCACAGCCCAGCTGTGGCTGCACAGTGAGCCTGATGGGAGGTGGGGAACAGGGACA GGGGGCCACCTGGGCTTCTTCACAGAGAGGTCAGCAGGAAGGCTTGGCTACAGTGCAAGGTTGGCTG AGCTG According to other preferred embodiments of the present invention, trophinin associated protein (tastin) or a fragment thereof comprises a biomarker for detecting lung cancer. Optionally and more preferably, trophinin associated protein (tastin) splice variants, as depicted in SEQ ID NO: 1485-1488, 1609, 1610 (e.g., variant no. 23-26, 31, 32), or a fragment thereof comprise a biomarker for detecting lung cancer. Optionally and more preferably, the fragment of trophinin associated protein (tastin) comprises segment_TAA-44— SEQ ID NO: 1507. Also optionally and more preferably, any suitable method may be used for detecting a fragment such as trophinin associated protein (tastin) _segment_ TAA-44— SEQ ID no 1507 for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to trophinin associated protein (tastin) as described above, including but not limited to SEQ ID NOs: 1492-1501, 1612. Any oligopeptide or peptide relating to such an amino acid sequence or fragment thereof may optionally also (additionally or alternatively) be used as a biomarker, including but not limited to the unique amino acid sequences of these proteins that are depicted in SEQ ID Nos: 1508-1511, 1613. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to trophinin associated protein (tastin) as described above, optionally for any application.

Expression of Trophinin Associated Protein (Tastin) [T86235] Transcripts which are Detectable by Oligonucleotides as Depicted in SEQ ID NOs:1512-1514 in Normal and Cancerous Lung Tissues Expression of trophinin associated protein (tastin) [T86235] transcripts detectable by oligonucleotides SEQ ID NOs: 1512-1514 (e.g., variants no. 8-10, 22, 23, 26, 27, 29-31, 33—represented by SEQ IDs 1481-1485, 1488-1491, 1609, 1611) was measured with oligonucleotide-based micro-arrays. The segments detected by the above oligonucleotides as depicted in SEQ ID NOs: 1512-1514 are for example nucleotide sequences as depicted in SEQ IDs 1503, 1504, 1506.

Figure 54B:
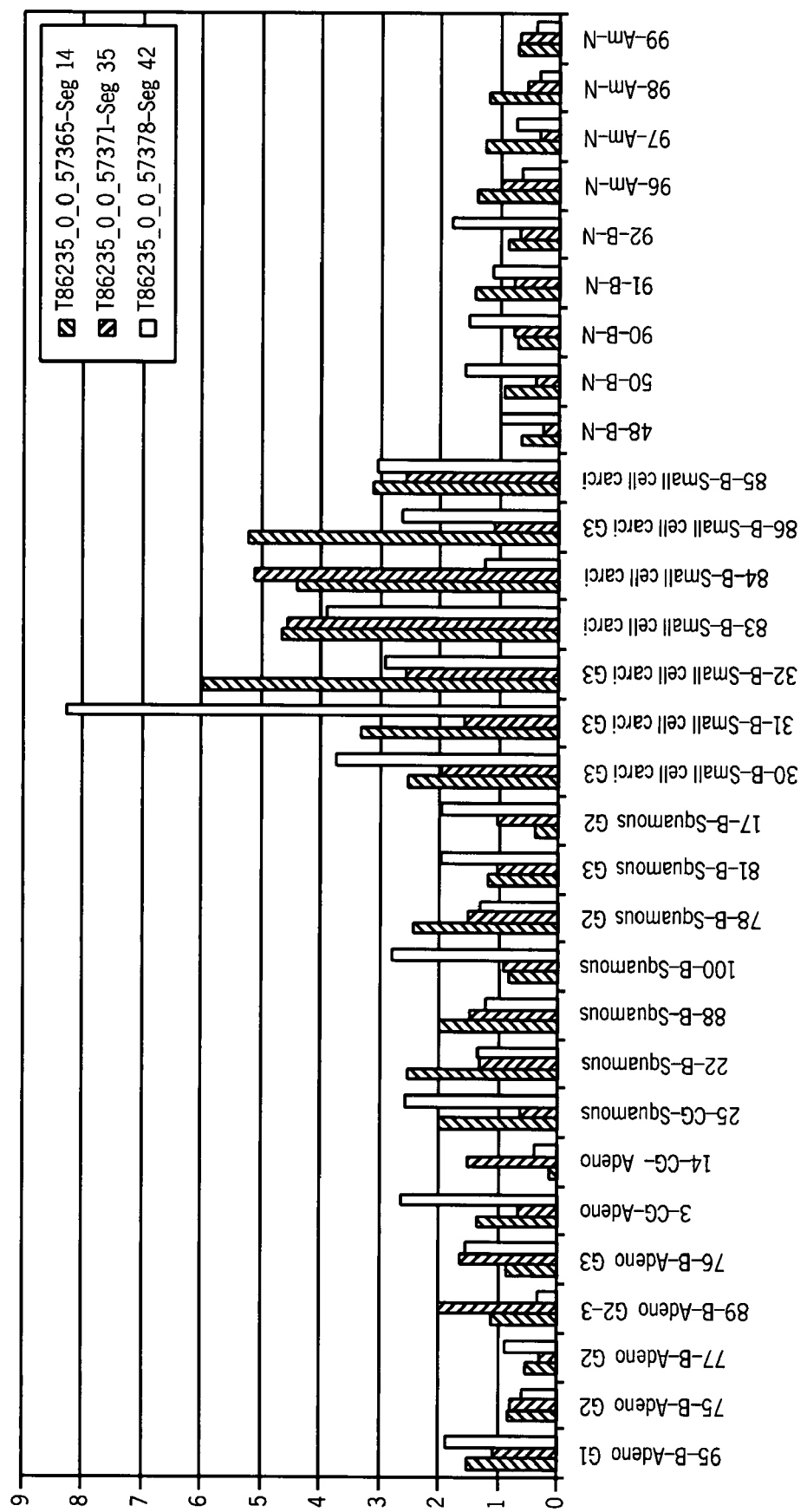
FIG. 54b is a histogram showing the relative expression of trophinin associated protein (tastin)) [T86235] variants (e.g., variant no. 8-10, 22, 23, 26, 27, 29-31, 33) in normal and tumor derived lung samples as determined micro-array analysis using oligos detailed in SEQ ID NO:1512-1514.

The results of image intensities for each feature were normalized according to the ninetieth percentile of the image intensities of all the features on the chip. Then, feature image intensities for replicates of the same oligonucleotide on the chip and replicates of the same sample were averaged. Outlying results were discarded. For every oligonucleotide (SEQ ID NOs: 1512-1514) the averaged intensity determined for every sample was divided by the averaged intensity of all the normal samples (Sample Nos. 48,50,90-92, 96-99, Table 2, "Tissue samples in testing panel", above), to obtain a value of fold up-regulation for each sample relative to the averaged normal samples. These data are presented in a histogram in FIG. 54b. As is evident from FIG. 54b, the expression of trophinin associated protein (tastin) [T86235] transcripts detectable with oligonucleotides according to SEQ ID NOs: 1512-1514 in cancer samples was significantly higher than in the normal samples.

According to the present invention, trophinin associated protein (tastin) is a non-limiting example of a marker for diagnosing lung cancer. Although optionally any method may be used to detected overexpression and/or differential expression of this marker, preferably a NAT-based technology is used. Therefore, optionally and preferably, any nucleic acid molecule capable of selectively hybridizing to trophinin associated protein (tastin) as previously defined is also encompassed within the present invention. Oligonucleotides are also optionally and preferably encompassed within the present invention; for example, for the above experiment, the following oligonucleotides were used as a non-limiting illustrative example only of a suitable oligonucleotides: SEQ ID NOs: 1512-1514

CATGGTAACACGGCCTCCATGGCTGAGTAGGGGACTAGGAAGGGTAAAAG (SEQ ID NO:1512)

TGTACATCTAGGGCCTCTCAGTTAGGGGCTTCAATCATTCCTCATGAGG (SEQ ID NO:1513)

TGTGAACACAAGAGGTCCTCACCTCACTGTGAGCTGCACACCTGCCCTGC (SEQ ID NO:1514)

According to other embodiments of the present invention, trophinin associated protein (tastin) or a fragment thereof comprises a biomarker for detecting lung cancer. Optionally and more preferably, trophinin associated protein (tastin) splice variants, as depicted in SEQ ID NO:1481-1485, 1488-1491, 1609, 1611 (e.g., variant no. 8-10, 22, 23, 26, 27, 29-31, 33), or a fragment thereof comprise a biomarker for detecting lung cancer. Optionally and more preferably, the fragment of trophinin associated protein (tastin) comprises segment_TAA-14, 35 and 42—SEQ ID no. 1503, 1504, 1506. Also optionally and more preferably, any suitable method may be used for detecting a fragment such as trophinin associated protein (tastin) _segment_TAA-14, 35 and 42—SEQ ID NOs 1503, 1504 and 1506 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, trophinin associated protein (tastin) splice variants containing the unique segments as depicted in SEQ ID Nos 1502 and 1505, for example as these included in variants 9 and 29 (SEQ ID NOs: 1482 and 1490, respectively), are useful as biomarkers for detecting lung cancer.

The present invention also optionally and preferably encompasses any nucleic acid sequence or fragment thereof, or amino acid sequence or fragment thereof, corresponding to trophinin associated protein (tastin) as described above, optionally for any application.

Expression of Homeo Box C10 (HOXC10) [N31842] Transcripts which are Detectable by Amplicon as Depicted in SEQ ID NO:1517 in Normal and Cancerous Lung Tissues Expression of Homeo box C10 (HOXC10) transcripts detectable by SEQ ID NO:1517 (e.g., variant no. 3, represented by SEQ ID 1519) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:3), Ubiquitin (GenBank Accession No. BC000449 (SEQ ID NO:1711); amplicon—SEQ ID NO:9) and SDHA (GenBank Accession No. NM_004168 (SEQ ID NO:1712); amplicon—SEQ ID NO:1477), was measured similarly. For each RT sample, the expression of SEQ ID NO:1517 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 55:
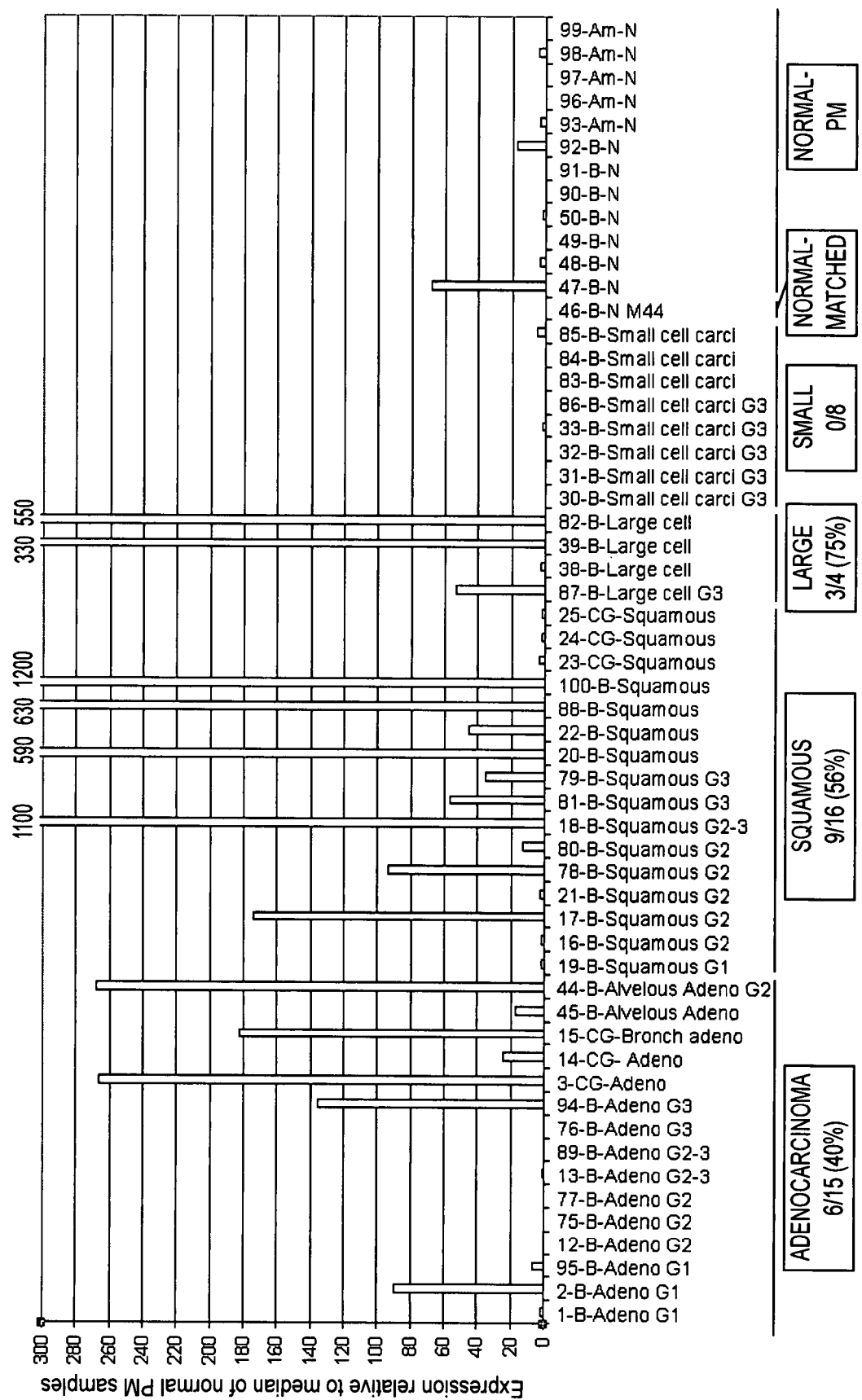
FIG. 55 is a histogram showing the relative expression of Homeo box C10 (HOXC10) [N31842] variants (e.g., variant no. 3) in normal and tumor derived lung samples as determined by real time PCR using primers for SEQ ID NO:1517.

FIG. 55 is a histogram showing over expression of the above-indicated Homeo box C10 (HOXC10) transcripts in cancerous lung samples relative to the normal samples. The number and percentage of samples that exhibit at least 20 fold over-expression, out of the total number of samples tested is indicated in the bottom.

As is evident from FIG. 55, the expression of Homeo box C10 (HOXC10) transcripts detectable by SEQ ID NO:1517 in cancer samples was significantly higher than in the non-cancerous samples (Sample Nos. 46-50, 90-93, 96-99, Table 2, "Tissue samples in testing panel"). Notably an over-expression of at least 20 fold was found in 6 out of 15 adenocarcinoma samples, 9 out of 16 squamous cell carcinoma samples, and in 3 out of 4 large cell carcinoma samples.

Statistical analysis was applied to verify the significance of these results, as described below. The P value for the difference in the expression levels of Homeo box C10 (HOXC10) transcripts detectable by SEQ ID NO:1517 in lung cancer samples versus the normal lung samples was determined by T test as 4.43E-03. Threshold of 20 fold overexpression was found to differentiate between cancer and normal samples with P value of 2.88E-02 as checked by exact fisher test. The above values demonstrate statistical significance of the results.

According to the present invention, Homeo box C10 (HOXC10) is a non-limiting example of a marker for diagnosing lung cancer. The Homeo box C10 (HOXC10) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Homeo box C10 (HOXC10) as previously defined is also encompassed within the present invention. Primer pairs are also optionally and preferably encompassed within the present invention; for example, for the above experiment, the following primer pair was used as a non-limiting illustrative example only of a suitable primer pair: Homeo box C10 (HOXC10)—forward primer (SEQ ID NO:1515): GCGAAACGCGATTTGTTGTT; and Homeo box C10 (HOXC10)—Reverse primer (SEQ ID NO:1516): CATCTG-GAGGAGGGAGGGA.

The present invention also preferably encompasses any amplicon obtained through the use of any suitable primer pair; for example, for the above experiment, the following amplicon was obtained as a non-limiting illustrative example only of a suitable amplicon: Homeo box C10 (HOXC10) amplicon (SEQ ID NO:1517): GCGAAACGCGATTTGT-TGTTTGTGGGTCTGATTTTGTGCGTGCGGCTTGGG-CTCCTGCGGCTTGTGGCTC GGCCGGGGGCCT-TGGGCAGCGAGGCTGGAGCCGGAAGAGGTGGA-GGTGAAGGGCTGCCCGCCACGT CCCTCCCTCCTC-CAGATG.

According to other preferred embodiments of the present invention, Homeo box C10 (HOXC10) or a fragment thereof comprises a biomarker for detecting lung cancer. Optionally and more preferably, Homeo box C10 (HOXC10) splice variants, as depicted in SEQ ID NO:54 (e.g., variant no. 3), or a fragment thereof comprise a biomarker for detecting lung cancer. Optionally and more preferably, the fragment of Homeo box C10 (HOXC10) comprises segment_TAA-seg 6 (SEQ ID NO: 1526). Also optionally and more preferably, any suitable method may be used for detecting a fragment such as Homeo box C10 (HOXC10) _segment_TAA-seg 6 (SEQ ID NO:1526) for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Homeo box C10 (HOXC10) splice variants containing the unique segments as depicted in SEQ ID NOs: 1524 and 1525, for example transcripts as depicted in SEQ ID NO:1515, 1519 and 1520, comprise a biomarker for detecting lung cancer.

According to still other preferred embodiments, the present invention optionally and preferably encompasses any amino acid sequence or fragment thereof encoded by a nucleic acid sequence corresponding to trophinin associated protein (tastin) as described above, including but not limited to SEQ ID NOs: 1521 and 1522. Any oligopeptide or peptide relating to such an amino acid sequence or fragment thereof may optionally also (additionally or alternatively) be used as a biomarker, including but not limited to the unique amino acid sequence of the protein SEQ ID NO: 1522, as depicted in SEQ ID NO:1523. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to trophinin associated protein (tastin) as described above, optionally for any application.

Expression of Nucleolar Protein 4 (NOL4)-[T06014] Transcripts which are Detectable by Amplicon as Depicted in SEQ IDs NO:1529 in Normal and Cancerous Lung Tissues Expression of Nucleolar protein 4 (NOL4) transcripts detectable by SEQ ID NOs: 1529 (e.g., variant no. 3, 11 and 12, represented by SEQ IDs 1533, 1537, 1538) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1529 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, above, "Tissue samples in testing panel"), to obtain a value of fold up-regulation for each sample relative to median of the normal PM samples.

Figure 56A:
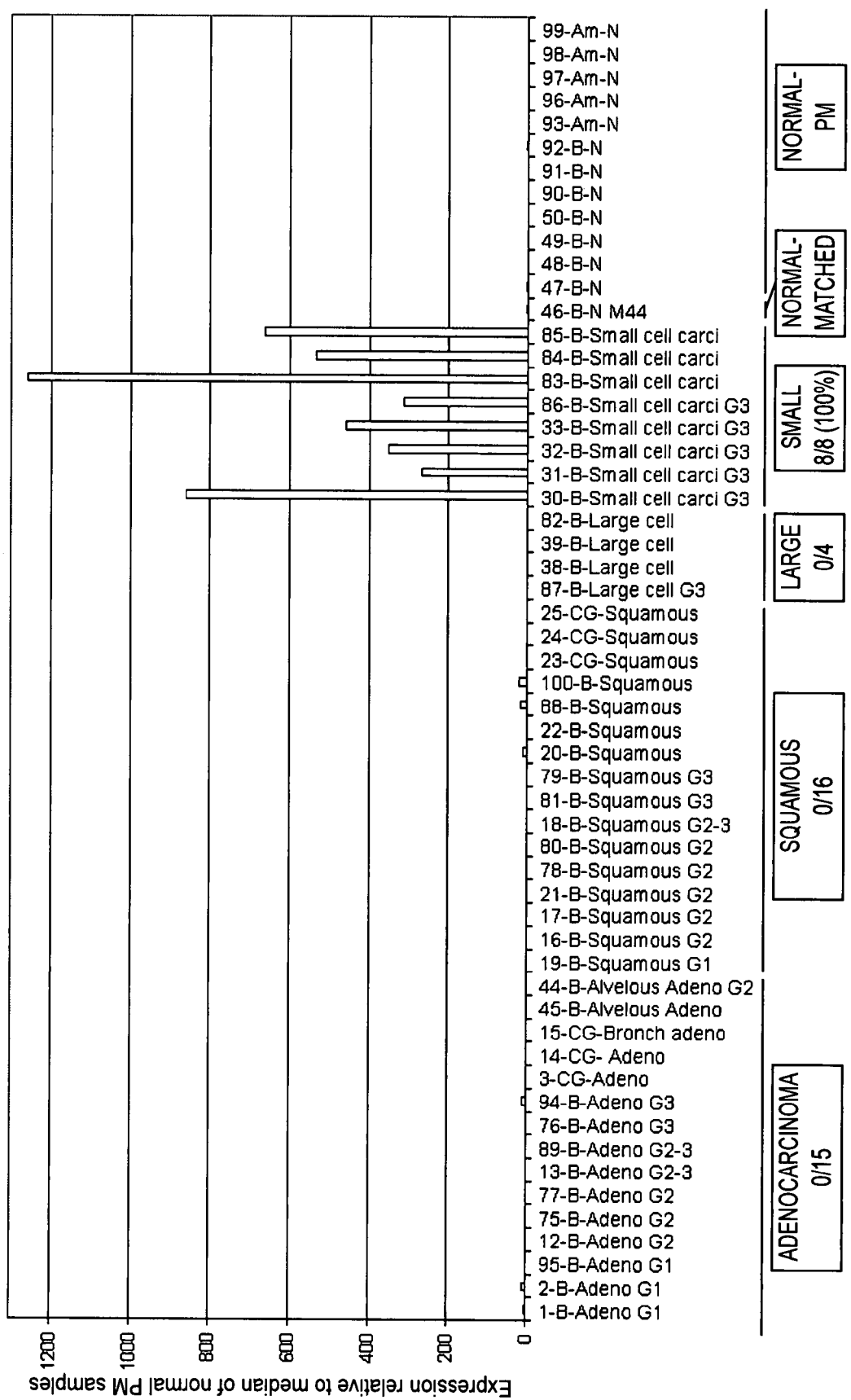
FIGS. 56a-b are histograms showing on two different scales the relative expression of Nucleolar protein 4 (NOL4) [T06014] variants (e.g., variant no. 3, 11 and 12) in normal and tumor derived lung samples as determined by real time PCR using primers for SEQ ID NO:1529.
Figure 56B:
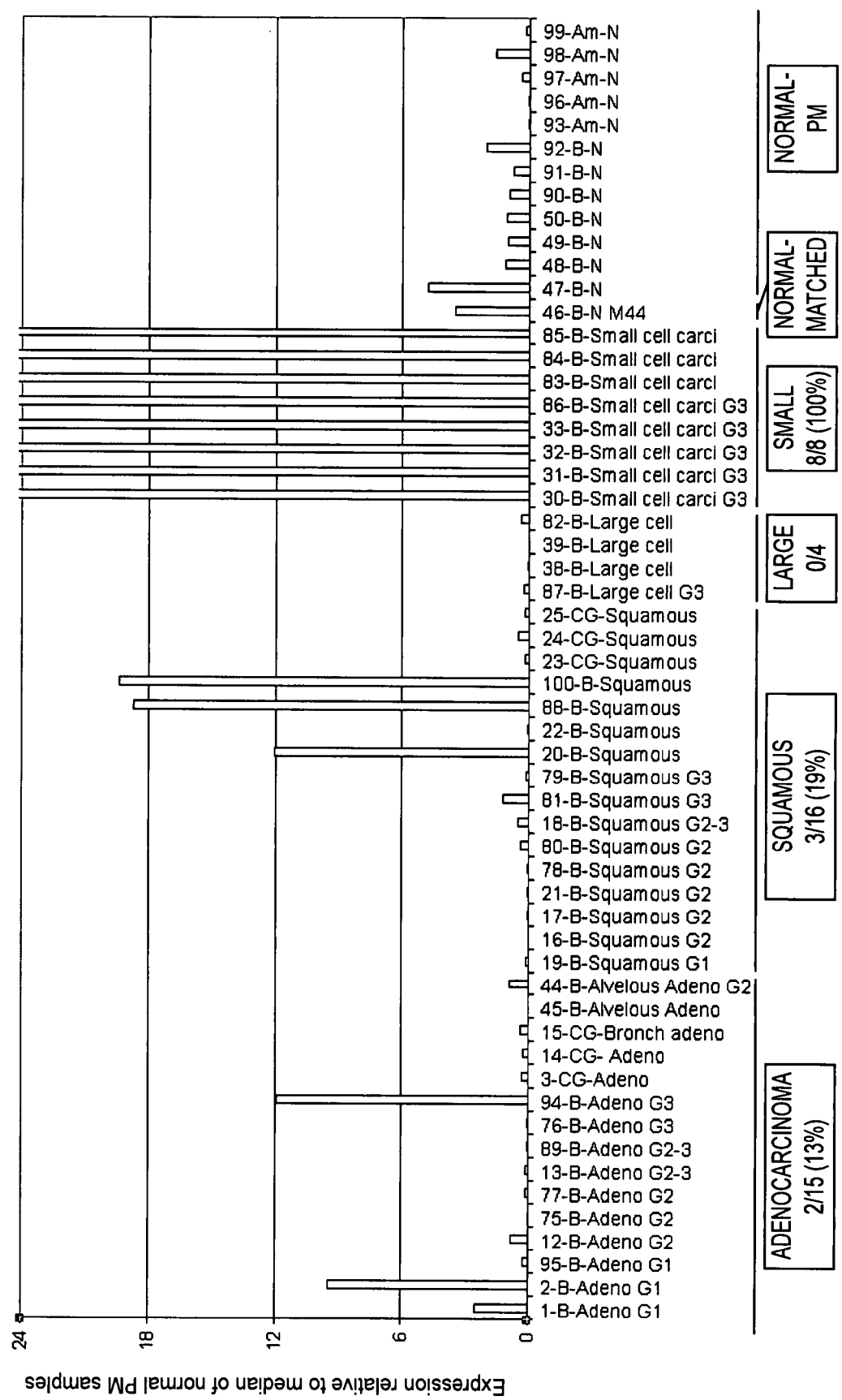

FIGS. 56a and b are histograms showing over expression of the above-indicated Nucleolar protein 4 (NOL4) transcripts in cancerous lung samples relative to the normal samples. The number and percentage of samples that exhibit at least 200 fold or 6 fold over-expression, out of the total number of samples tested is indicated in the bottom of FIGS. 56a and 56b respectively.

As is evident from FIG. 56a, the expression of Nucleolar protein 4 (NOL4) transcripts detectable by SEQ ID NO:1529 in the samples originate from small cell carcinoma of the lung was significantly higher than in the non-cancerous samples (Sample Nos. 46-50, 90-93, 96-99, Table 2, "Tissue samples in testing panel"). Notably an over-expression of at least 200 fold was found in 8 out of 8 small cell carcinoma samples. As is evident from FIG. 56b, over expression of at least 6 fold was observed also in 2 out of 15 adenocarcinoma samples, 3 out of 16 squamous cell carcinoma samples.

Statistical analysis was applied to verify the significance of these results, as described below.

The P value for the difference in the expression levels of Nucleolar protein 4 (NOL4) transcripts detectable by SEQ ID NO:1529 in lung cancer samples versus the normal lung samples was determined by T test as 1.36E-02.

Threshold of 6 fold overexpression was found to differentiate between cancer and normal samples with P value of 2.52E-02 as checked by exact fisher test.

The P value for the difference in the expression levels of Nucleolar protein 4 (NOL4) transcripts detectable by SEQ ID NO:1529 in lung small cell carcinoma samples versus the normal lung samples was determined by T test as 3.86E-03.

Threshold of 200 fold overexpression was found to differentiate between small cell carcinoma and normal lung samples with P value of 7.94E-06 as checked by exact fisher test.

The above values demonstrate statistical significance of the results.

According to the present invention, Nucleolar protein 4 (NOL4) is a non-limiting example of a marker for diagnosing lung cancer. The Nucleolar protein 4 (NOL4) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Nucleolar protein 4 (NOL4) as previously defined is also encompassed within the present invention. Primer pairs are also optionally and preferably encompassed within the present invention; for example, for the above experiment, the following primer pair was used as a non-limiting illustrative example only of a suitable primer pair: Nucleolar protein 4 (NOL4)-TAA-seg1-forward primer (SEQ ID NO:1527): CTCGCTCCCTTGCTCACAC; and Nucleolar protein 4 (NOL4)-TAA-seg1-Reverse primer (SEQ ID NO:1528): AAAGGGAAAGCGGGATGTTT.

The present invention also preferably encompasses any amplicon obtained through the use of any suitable primer pair; for example, for the above experiment, the following amplicon was obtained as a non-limiting illustrative example only of a suitable amplicon: Nucleolar protein 4 (NOL4) amplicon (SEQ ID NO:1529): CTCGCTCCCTTGCTCACACACACGCACACACTCAGCCTGGCCGAGCAGGAGCCACTGACCATTTTGCAAGTGTCAGG ACCAGCTACAGCGCGGTGGGCGCAAACATCCCGCTTTCCCTTT.

According to other preferred embodiments of the present invention, Nucleolar protein 4 (NOL4) or a fragment thereof comprises a biomarker for detecting lung cancer. Optionally and more preferably, Nucleolar protein 4 (NOL4) splice variants, as depicted in SEQ ID NO:1529 (e.g., variants nos. 3, 11 and 12), or a fragment thereof comprise a biomarker for detecting lung cancer. Optionally and more preferably, the fragment of Nucleolar protein 4 (NOL4) comprises segment_TAA-seg-1 (SEQ ID NO: 1552). Also optionally and more preferably, any suitable method may be used for detecting a fragment such as Nucleolar protein 4 (NOL4)_segment_TAA-seg-1 (SEQ ID NO: 1552) for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Nucleolar protein 4 (NOL4) splice variants containing the unique segments as depicted in SEQ ID NOs: 1554 and 1555, for example transcripts as depicted in SEQ ID NOs: 1534-1536 and 1539-1541, comprises a biomarker for detecting lung cancer.

According to still other preferred embodiments, the present invention optionally and preferably encompasses any amino acid sequence or fragment thereof encoded by a nucleic acid sequence corresponding to Nucleolar protein 4 (NOL4) as described above, including but not limited to SEQ ID Nos: 1542, 1547 and 1543; 1548, 1545, 1546, and 1549-1551. Any oligopeptide or peptide relating to such an amino acid sequence or fragment thereof may optionally also (additionally or alternatively) be used as a biomarker, including but not limited to the unique amino acid sequence of the protein SEQ ID NO:1543, 1546, 1549 as depicted in SEQ ID NO:1544.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of Nucleolar Protein 4 (NOL4)-[T06014] transcripts which are detectable by amplicon as depicted in SEQ IDs NO:1532 in Normal and Cancerous Lung Tissues Expression of Nucleolar protein 4 (NOL4) transcripts detectable by SEQ ID NOs: 1532 (e.g., variant no. 3, 11 and 12, represented by SEQ IDs 1533, 1537, 1538) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1481), was measured similarly. For each RT sample, the expression of SEQ ID NO:1532 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 57A:
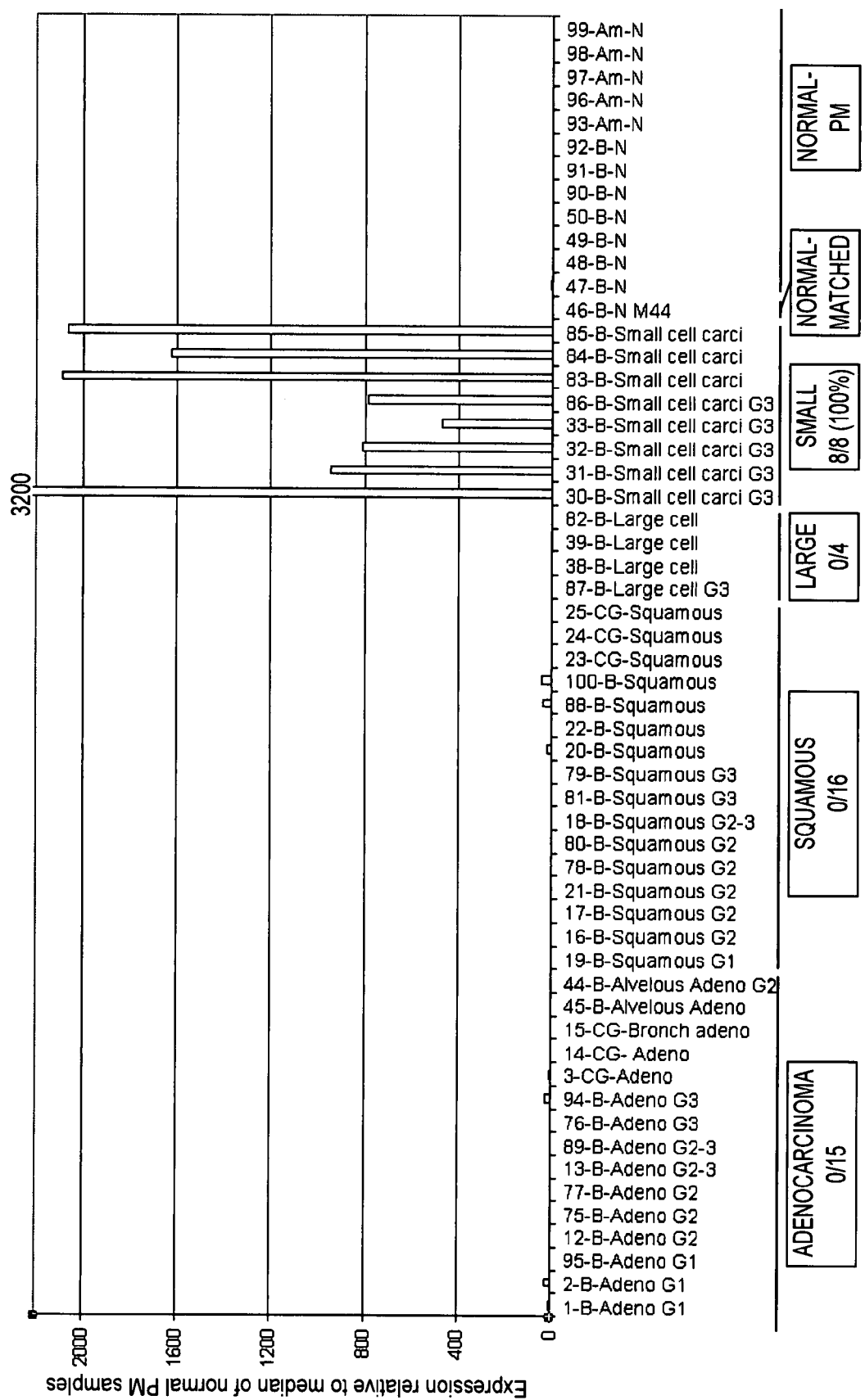
FIGS. 57a-b is a histogram showing on two different scales the relative expression of Nucleolar protein 4 (NOL4) [T06014] variants (e.g., variant no. 3, 11 and 12) in normal and tumor derived lung samples as determined by real time PCR using primers for SEQ ID NO:1532.
Figure 57B:
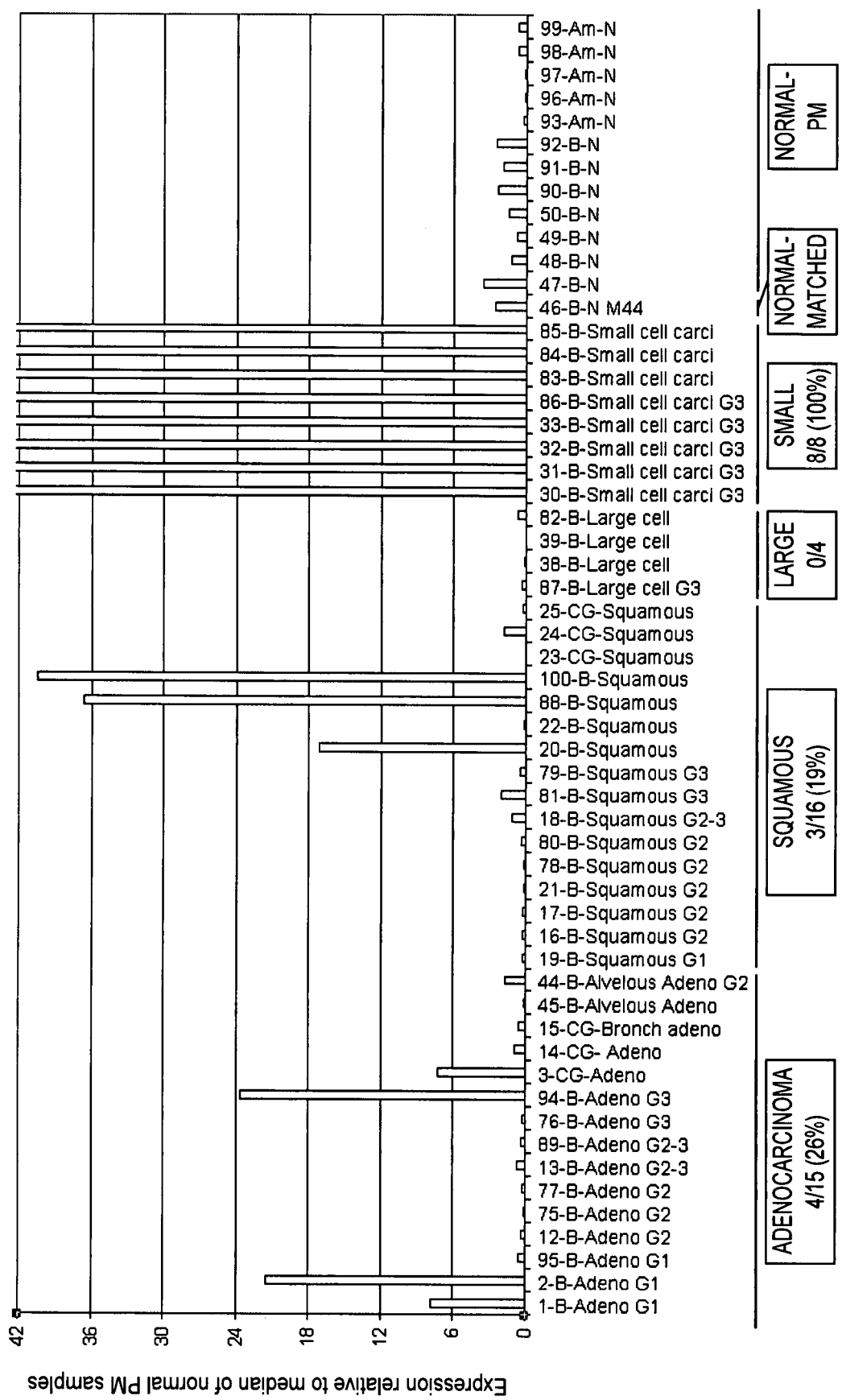

FIGS. 57a and b are histograms showing over expression of the above-indicated Nucleolar protein 4 (NOL4) transcripts in cancerous lung samples relative to the normal samples. The number and percentage of samples that exhibit at least 400 fold or 6 fold over-expression, out of the total number of samples tested is indicated in the bottom of FIGS. 57a and b respectively.

As is evident from FIG. 57a, the expression of Nucleolar protein 4 (NOL4) transcripts detectable by SEQ ID NO:1532 in the samples originate from small cell carcinoma of the lung was significantly higher than in the non-cancerous samples (Sample Nos. 46-50, 90-93, 96-99, Table 2, "Tissue samples in testing panel"). Notably an over-expression of at least 400 fold was found in 8 out of 8 small cell carcinoma samples. As is evident from FIG. 4b, over expression of at least 6 fold was observed also in 4 out of 15 adenocarcinoma samples, 3 out of 16 squamous cell carcinoma samples.

Statistical analysis was applied to verify the significance of these results, as described below.

The P value for the difference in the expression levels of Nucleolar protein 4 (NOL4) transcripts detectable by SEQ ID NO:1532 in lung cancer samples versus the normal lung samples was determined by T test as 1.70E-02.

Threshold of 6 fold overexpression was found to differentiate between cancer and normal samples with P value of 1.80E-02 as checked by exact fisher test.

The P value for the difference in the expression levels of Nucleolar protein 4 (NOL4) transcripts detectable by SEQ ID NO:1532 in lung small cell carcinoma samples versus the normal lung samples was determined by T test as 7.08E-03.

Threshold of 400 fold overexpression was found to differentiate between small cell carcinoma and normal lung samples with P value of 1.03E-04 as checked by exact fisher test.

The above values demonstrate statistical significance of the results.

According to the present invention, Nucleolar protein 4 (NOL4) is a non-limiting example of a marker for diagnosing lung cancer. The Nucleolar protein 4 (NOL4) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Nucleolar protein 4 (NOL4) as previously defined is also encompassed within the present invention. Primer pairs are also optionally and preferably encompassed within the present invention; for example, for the above experiment, the following primer pair was used as a non-limiting illustrative example only of a suitable primer pair: Nucleolar protein 4 (NOL4)-TAA-seg 3-forward primer (SEQ ID NO: 1530): ACATCCCCCTGGAACGGAT; and Nucleolar protein 4 (NOL4)-TAA-seg 3-Reverse primer (SEQ ID NO:1531): CAGAAATTAGCAAAGCATTGATGG.

The present invention also preferably encompasses any amplicon obtained through the use of any suitable primer pair; for example, for the above experiment, the following amplicon was obtained as a non-limiting illustrative example only of a suitable amplicon: Nucleolar protein 4 (NOL4) amplicon (SEQ ID NO:1532): ACATCCCCCTGGAACG-GATATCTGTTTGGGGCACTACAATCTATCCTGTAGA-ACTATGGCCAAATCTC CATCAATGCTTTGCTAAT-TTCTG.

According to other preferred embodiments of the present invention, Nucleolar protein 4 (NOL4) or a fragment thereof comprises a biomarker for detecting lung cancer. Optionally and more preferably, Nucleolar protein 4 (NOL4) splice variants, as depicted in SEQ ID NO:1533, 1537, 1538 (e.g., variants nos. 3, 11, 12), or a fragment thereof comprise a biomarker for detecting lung cancer. Optionally and more preferably, the fragment of Nucleolar protein 4 (NOL4) comprises segment_TAA-seg-3 (SEQ ID NO:1553). Also optionally and more preferably, any suitable method may be used for detecting a fragment such as Nucleolar protein 4 (NOL4)_segment_TAA-seg-3 (SEQ ID NO:1553) for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to Nucleolar protein 4 (NOL4) as described above, including but not limited to SEQ ID NOs: SEQ ID Nos: 1542, 1547 and 1548. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of AA281370 Transcripts which are Detectable by Amplicon as Depicted in SEQ ID NO:1558 in Normal and Cancerous Lung Tissues AA281370 gene was identified by a computational process described above as over expressed in lung cancer. The AA281370 encoded proteins (SEQ ID NO: 1563, 1564) contain several WD40 domains, which are found in a number of eukaryotic proteins that cover a wide variety of functions, including adaptor/regulatory modules in signal transduction, pre-mRNA processing and cytoskeleton assembly. As is demonstrated in FIG. 63, the WD40 domain region of AA281370 encoded protein, depicted in SEQ ID NO: 1564, has several similarities that might suggest involvement in signal transduction MAPK pathway. For example, the region of the AA281370 polypeptide SEQ ID NO: 1564 located between amino acids at positions 40-790 has 75% homology to the WD40 domain region of mouse Mapkbp1 protein (gi|47124622) (FIG. 63a); and the amino acids at positions 40-886 of the AA281370 polypeptide SEQ ID NO:1564 has 70% homology to rat JNK-binding protein JNKBP1 (gi|34856717) (FIG. 63b).

Expression of AA281370 transcripts detectable by SEQ ID NO:1558 (e.g., variant no. 0, 1, 4 and 5, represented in SEQ IDs 1559-1562) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1558 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 58:
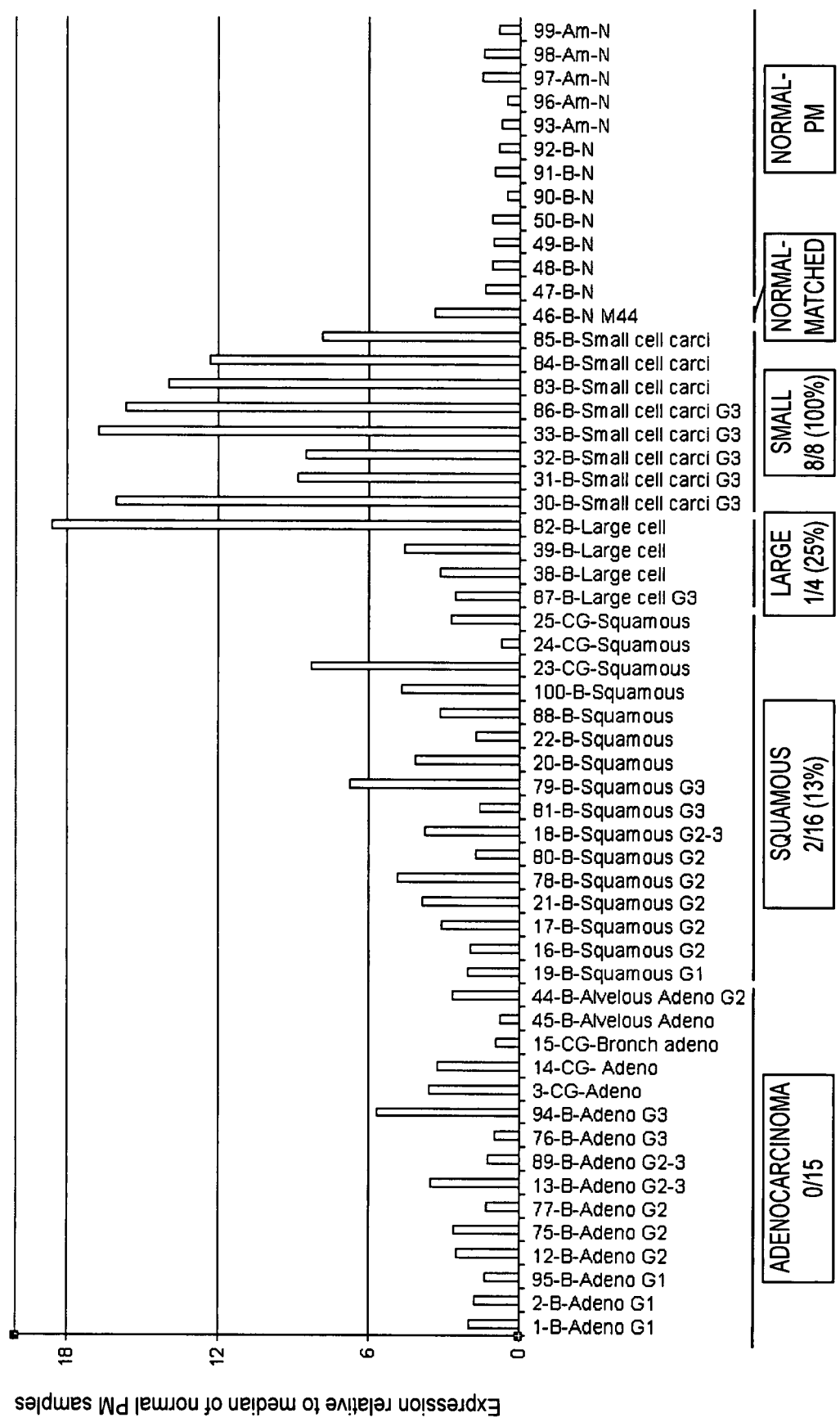
FIG. 58 is a histogram showing the relative expression of AA281370 variants (e.g., variant no. 0, 1, 4 and 5) in normal and tumor derived lung samples as determined by real time PCR using primers for SEQ ID NO:1558.

FIG. 58 is a histogram showing over expression of the above-indicated AA281370 transcripts in cancerous lung samples relative to the normal samples. The number and percentage of samples that exhibit at least 6 fold over-expression, out of the total number of samples tested is indicated in the bottom.

As is evident from FIG. 58, the expression of AA281370 transcripts detectable by SEQ ID NO:1558 in cancer samples was significantly higher than in the non-cancerous samples (Sample Nos. 46-50, 90-93, 96-99, Table 2, "Tissue samples in testing panel"). Notably an over-expression of at least 6 fold was found in 8 out of 8 small cell carcinoma, 2 out of 16 squamous cell carcinoma samples, and in 1 out of 4 large cell carcinoma samples.

Statistical analysis was applied to verify the significance of these results, as described below.

The P value for the difference in the expression levels of AA281370 transcripts detectable by SEQ ID NO:1558 in lung cancer samples versus the normal lung samples was determined by T test as 8.58E-07.

Threshold of 6 fold overexpression was found to differentiate between cancer and normal samples with P value of 4.81E-02 as checked by exact fisher test.

The above values demonstrate statistical significance of the results.

According to the present invention, AA281370 transcripts are a non-limiting example of a marker for diagnosing lung cancer. The AA281370 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to AA281370 as previously defined is also encompassed within the present invention. Primer pairs are also optionally and preferably encompassed within the present invention; for example, for the above experiment, the following primer pair was used as a non-limiting illustrative example only of a suitable primer pair: AA281370-forward primer (SEQ ID NO: 1556): GGTTCG-GATGGACTACACTTTGTC; and AA281370-Reverse primer (SEQ ID NO: 1557): CCACGTACTRCTGGGTGAT-GTC.

The present invention also preferably encompasses any amplicon obtained through the use of any suitable primer pair; for example, for the above experiment, the following amplicon was obtained as a non-limiting illustrative example only of a suitable amplicon: AA281370-amplicon (SEQ ID NO: 1558): GGTTCGGATGGACTACACTTTGTCCG-TACCCACCACGTAGCAGAGAAAACCAC-CTTGTATGACATGGA CATTGACATCACCCAGAAG-TACGTGG.

According to other preferred embodiments of the present invention, AA281370 or a fragment thereof comprises a biomarker for detecting lung cancer. Optionally and more preferably, AA281370 splice variants, as depicted in SEQ ID NO:1558 (e.g., variants no: 0, 1, 4 and 5), or a fragment thereof comprise a biomarker for detecting lung cancer. Optionally and more preferably, the fragment of AA281370 comprises segment_TAA seg 10 SEQ ID NO:1567, Also optionally and more preferably, any suitable method may be used for detecting a fragment such as AA281370_segment_TAA seg 10 SEQ ID NO:1567 for example. Most preferably, NAT-based technology used, such as any nucleic acid molecule capable of specifically hybridizing with the fragment. Optionally and most preferably, a primer pair is used for obtaining the fragment.

According to other preferred embodiments, the present invention also optionally and preferably encompasses AA281370 splice variants containing the unique segments as depicted in SEQ ID NO:1568, for example transcripts 4 and 5, as depicted in SEQ ID NOs: 1561 and 1562, comprises a biomarker for detecting lung cancer.

According to still other preferred embodiments, the present invention optionally and preferably encompasses any amino acid sequence or fragment thereof encoded by a nucleic acid sequence corresponding to AA281370 as described above, including but not limited to SEQ ID NOs: 1563-1566. Any oligopeptide or peptide relating to such an amino acid sequence or fragment thereof may optionally also (additionally or alternatively) be used as a biomarker, including but not limited to the unique amino acid sequence of the proteins SEQ ID NOs: 1563-1566, as depicted in SEQ ID NOs: 1569, 1570 and 1571.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to AA281370 as described above, optionally for any application.

Expression of Sulfatase 1 (SULF1)-[Z21368], Transcripts which are Detectable by Amplicon as Depicted in SEQ ID NO:1574 in Normal and Cancerous Lung Tissues SULF1 is a secreted protein which is found in the extracellular matrix. It is known to be downregulated in many epithelial cancer types.

Expression of Sulfatase 1 (SULF1) transcripts detectable by SEQ ID NO:1574 (e.g., variant no. 13 and 14, represented in SEQ ID 1578, 1579) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO:1574 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 59:
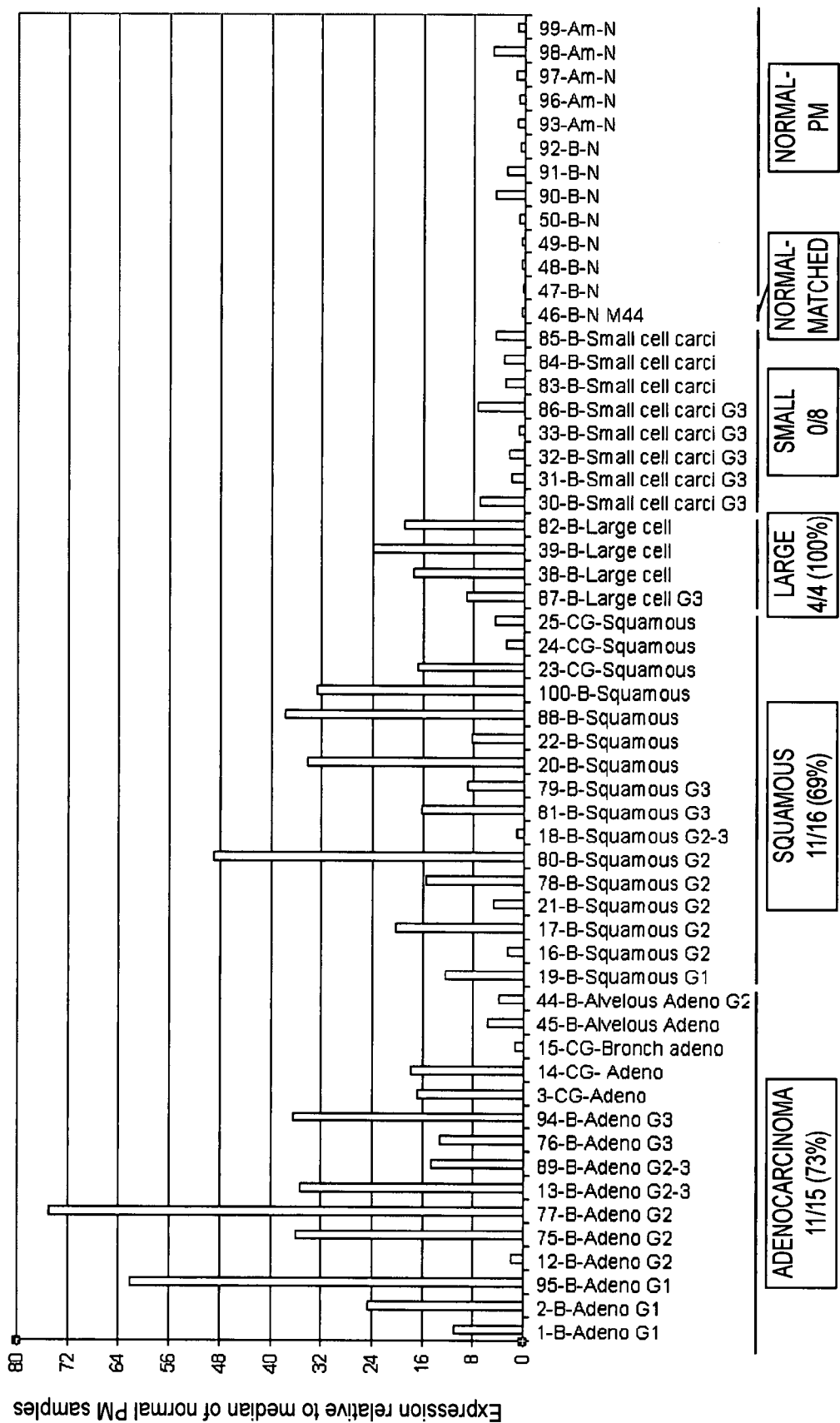
FIG. 59 is a histogram showing the relative expression of Sulfatase 1 (SULF1)-[Z21368] variants (e.g., variant no. 13 and 14) in normal and tumor derived lung samples as determined by real time PCR using primers for SEQ ID NO:1574.

FIG. 59 is a histogram showing over expression of the above-indicated Sulfatase 1 (SULF1) transcripts in cancerous lung samples relative to the normal samples. The number and percentage of samples that exhibit at least 8 fold over-expression, out of the total number of samples tested is indicated in the bottom.

As is evident from FIG. 59, the expression of Sulfatase 1 (SULF1) transcripts detectable by SEQ ID NO: 1574 in cancer samples originate from non-cell carcinoma was significantly higher than in the non-cancerous samples (Sample Nos. 46-50, 90-93, 96-99, Table 2, "Tissue samples in testing panel"). Notably an over-expression of at least 8 fold was found in 11 out of 15 adenocarcinoma samples, 11 out of 16 squamous cell carcinoma samples, and in 4 out of 4 large cell carcinoma samples.

Statistical analysis was applied to verify the significance of these results, as described below.

The P value for the difference in the expression levels of Sulfatase 1 (SULF1) transcripts detectable by SEQ ID NO:1574 in lung cancer samples versus the normal lung samples was determined by T test as 3.18E-07. Threshold of 8 fold overexpression was found to differentiate between cancer and normal samples with P value of 1.18E-04 as checked by exact fisher test.

The above values demonstrate statistical significance of the results.

According to the present invention, Sulfatase 1 (SULF1) is a non-limiting example of a marker for diagnosing lung cancer. The Sulfatase 1 (SULF1) marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to Sulfatase 1 (SULF1) as previously defined is also encompassed within the present invention. Primer pairs are also optionally and preferably encompassed within the present invention; for example, for the above experiment, the following primer pair was used as a non-limiting illustrative example only of a suitable primer pair: Sulfatase 1 (SULF1)—forward primer (SEQ ID NO:1572): ACTCACTCAGAGACTAACACAAAGGAAG; and Sulfatase 1 (SULF1)—Reverse primer (SEQ ID NO:1573): AGTATGGGAAGAATTTACTGGTCACA.

The present invention also preferably encompasses any amplicon obtained through the use of any suitable primer pair; for example, for the above experiment, the following amplicon was obtained as a non-limiting illustrative example only of a suitable amplicon: Sulfatase 1 (SULF1)—amplicon (SEQ ID NO:1574): ACTCACTCAGAGACTAACA-CAAAGGAAGTAATTTCTTACCTGGTCATTATTTAG-TCTACAATAAGTTC ATCCTTCTTCAGTGTGACCAG-TAAATTCTTCCCATACT.

According to other preferred embodiments of the present invention, Sulfatase 1 (SULF1) or a fragment thereof comprises a biomarker for detecting lung cancer. Optionally and more preferably, Sulfatase 1 (SULF1) splice variants, as depicted in SEQ ID NO:1578, 1579 (e.g., variants no: 13 and 14), or a fragment thereof comprise a biomarker for detecting lung cancer. Optionally and more preferably, the fragment of Sulfatase 1 (SULF1) comprises segment_TAA seg 5—SEQ ID NO:1587. Also optionally and more preferably, any suitable method may be used for detecting a fragment such as Sulfatase 1 (SULF1) _segment_TAA seg 5—SEQ ID NO: 1587 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Sulfatase 1 (SULF1) splice variants containing the unique segments as depicted in SEQ ID NOs: 1588-1591, for example transcripts as depicted in SEQ ID NOs: 1575-1577, comprises a biomarker for detecting lung cancer.

According to still other preferred embodiments, the present invention optionally and preferably encompasses any amino acid sequence or fragment thereof encoded by a nucleic acid sequence corresponding to Sulfatase 1 (SULF1) as described above, including but not limited to SEQ ID NOs:1586, 1580, 1582, 1584. Any oligopeptide or peptide relating to such an amino acid sequence or fragment thereof may optionally also (additionally or alternatively) be used as a biomarker, including but not limited to the unique amino acid sequence of the protein SEQ ID NO: 1580, 1582, 1584, as depicted in SEQ ID NO: 1581, 1583, 1585, respectively.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to Nucleolar protein 4 (NOL4) as described above, optionally for any application.

Expression of SRY (Sex Determining Region Y)-box 2 (SOX2))-[HUMHMGBOX7, Transcripts which are Detectable by the Amplicon as Depicted in SEQ ID NO:1594 in Normal and Cancerous Lung Tissues Expression of SOX2 transcripts detectable by SEQ ID NO:1594 (e.g., variant no. 0 represented by SEQ ID 1595) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO: 1594 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 60:
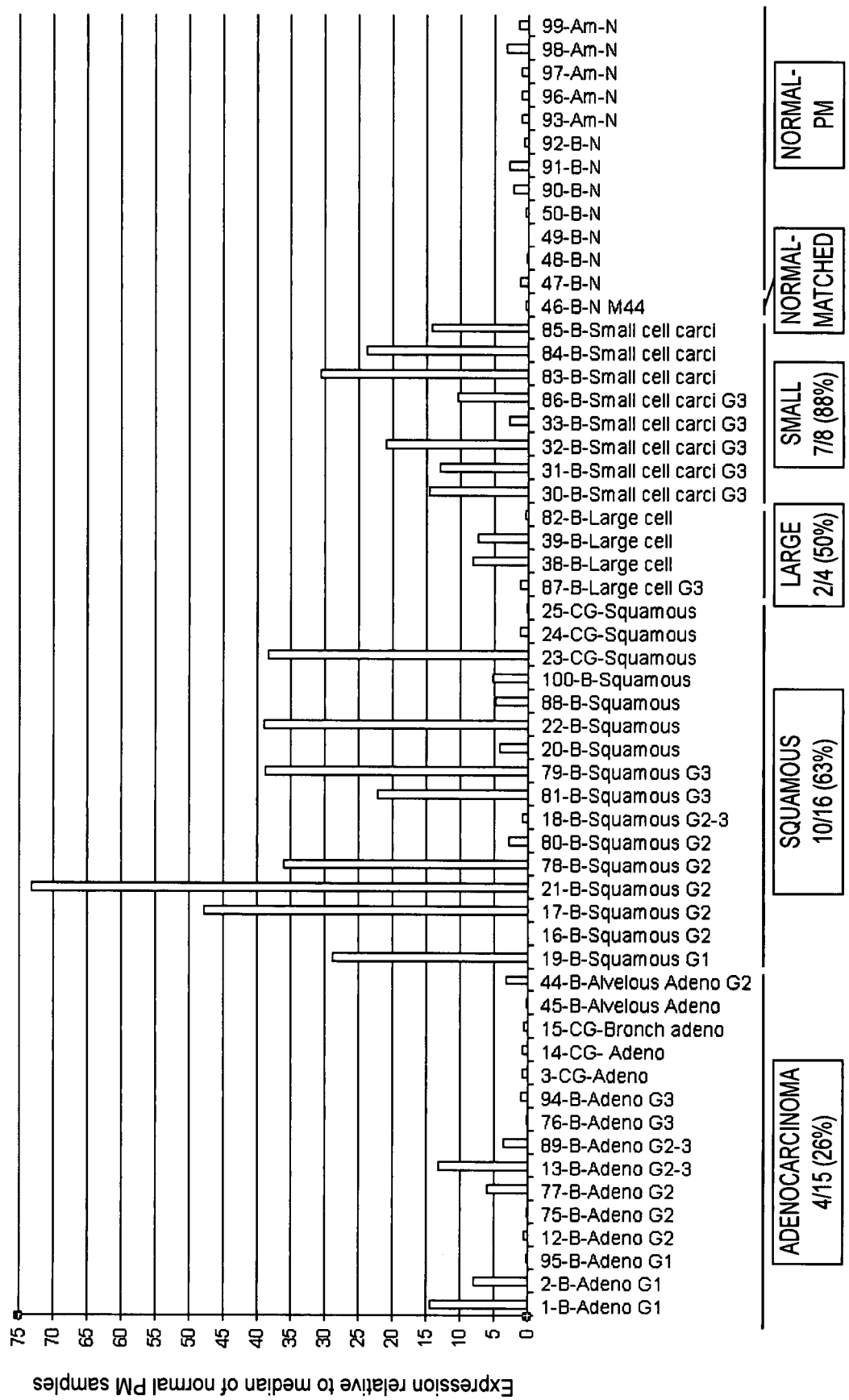
FIG. 60 is a histogram showing the relative expression of SRY (sex determining region Y)-box 2 (SOX2))-[HUMHMGBOX] variants (e.g., variant no. 0) in normal and tumor derived lung samples as determined by real time PCR using primers for SEQ ID NO:1594.

FIG. 60 is a histogram showing over expression of the above-indicated SOX2 transcripts in cancerous lung samples relative to the normal samples. The number and percentage of samples that exhibit at least 5 fold over-expression, out of the total number of samples tested is indicated in the bottom.

As is evident from FIG. 60, the expression of SOX2 transcripts detectable by SEQ ID NO:1594 in cancer samples originate from lung carcinoma was significantly higher than in the non-cancerous samples (Sample Nos. 46-50, 90-93, 96-99, Table 2, "Tissue samples in testing panel"). Notably an over-expression of at least 5 fold was found in 4 out of 15 adenocarcinoma samples, 10 out of 16 squamous cell carcinoma samples, in 2 out of 4 large cell carcinoma, and in 7 out of 8 small cell carcinoma samples.

Statistical analysis was applied to verify the significance of these results, as described below.

The P value for the difference in the expression levels of SOX2 transcripts detectable by SEQ ID NO: 1594 in lung cancer samples versus the normal lung samples was determined by T test as 4.38E-05. Threshold of 5 fold overexpression was found to differentiate between cancer and normal samples with P value of 8.09E-04 as checked by exact fisher test.

The above values demonstrate statistical significance of the results.

According to the present invention, SOX2 is a non-limiting example of a marker for diagnosing lung cancer. The SOX2 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to SOX2 as previously defined is also encompassed within the present invention. Primer pairs are also optionally and preferably encompassed within the present invention; for example, for the above experiment, the following primer pair was used as a non-limiting illustrative example only of a suitable primer pair: SOX2-forward primer (SEQ ID NO:1592): GGCGGCGGCAGGAT; and SOX2-Reverse primer (SEQ ID NO:1593): GTCGGGAGCGCAGGG.

The present invention also preferably encompasses any amplicon obtained through the use of any suitable primer pair; for example, for the above experiment, the following amplicon was obtained as a non-limiting illustrative example only of a suitable amplicon: SOX2—amplicon (SEQ ID NO:1594): GGCGGCGGCAGGATCGGCCAGAGGAG-GAGGGAAGCGCTTTTTTTGTATTCCTGATTCCAGTT-TGCCTCTC TCTTTTTTTCCCCCAAATTATTCTTCGC-CTGATTTTCCTCGCGGAGCCCTGCGCTCCCGAC.

According to other preferred embodiments of the present invention, SOX2 or a fragment thereof comprises a biomarker for detecting lung cancer. Optionally and more preferably, SOX2 splice variants, as depicted in SEQ ID NO:1595 (e.g., variants no: 0), or a fragment thereof comprise a biomarker for detecting lung cancer. Optionally and more preferably, the fragment of SOX2 comprises segment_TAA seg 2—SEQ ID NO:1597. Also optionally and more preferably, any suitable method may be used for detecting a fragment such as SOX2_segment_ TAA seg 2—SEQ ID NO:1597 for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to SOX2 as described above, including but not limited to SEQ ID NOs: SEQ ID NO:1596. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to SOX2 as described above, optionally for any application.

Expression of Plakophilin 1 (Ectodermal Dysplasia/Skin Fragility Syndrome) (PKP1)-[HSB6PR], Transcripts which are Detectable by the Amplicon as Depicted in SEQ ID NO:1600 in Normal and Cancerous Lung Tissues Expression of PKP1 transcripts detectable by SEQ ID NO:1600 (e.g., variant no. 0, 5 and 6—represented by SEQ IDs 1601-1603) was measured by real time PCR. In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO:1477), was measured similarly. For each RT sample, the expression of SEQ ID NO: 1600 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel"

above), to obtain a value of fold up-regulation for each sample relative to median of the normal PM samples.

Figure 61:
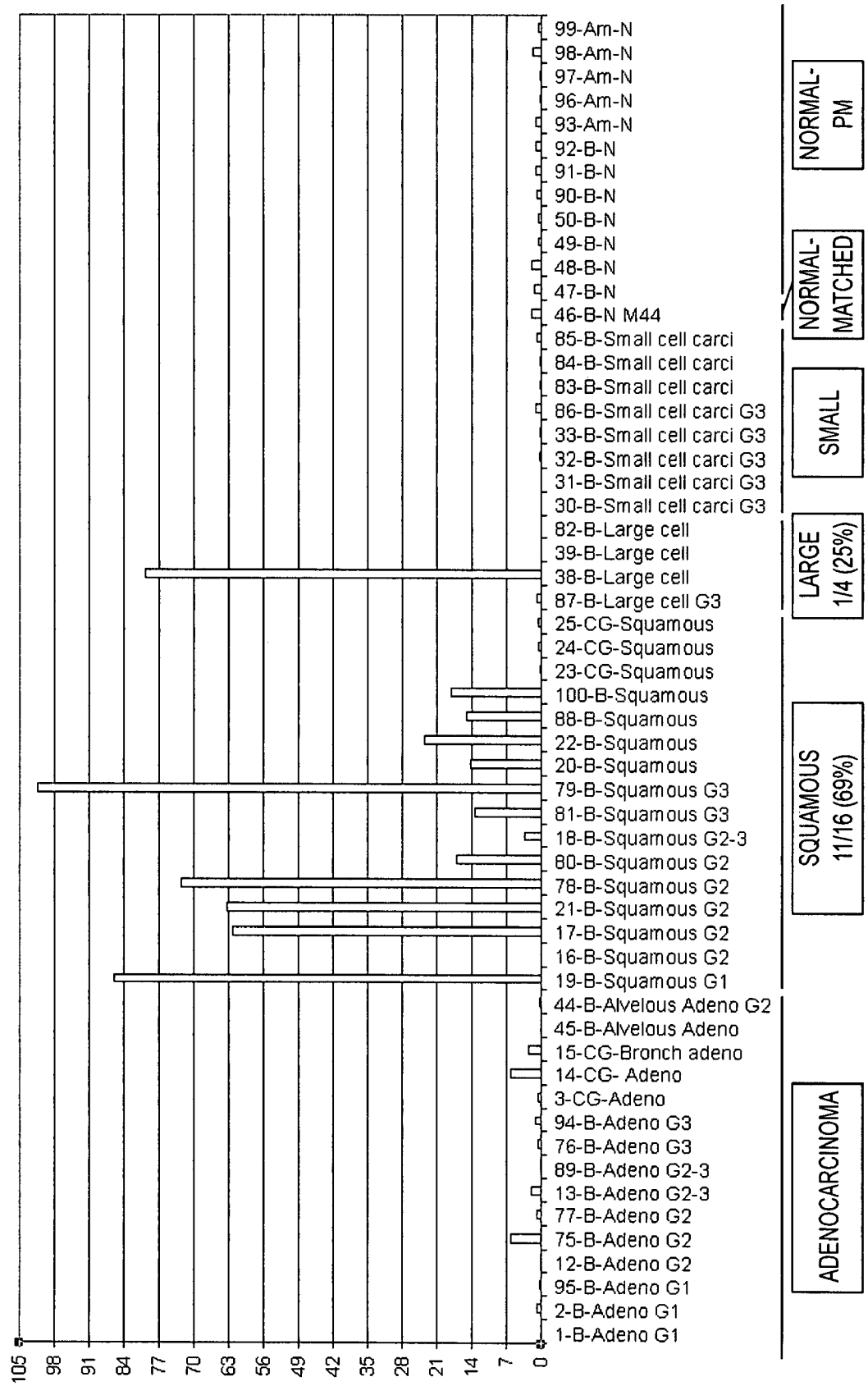
FIG. 61 is a histogram showing the relative expression of Plakophilin 1 (ectodermal dysplasia/skin fragility syndrome) (PKP1)-[HSB6PR] variants (e.g., variant no. 0, 5 and 6) in normal and tumor derived lung samples as determined by real time PCR using primers for SEQ ID NO:1600.

FIG. 61 is a histogram showing over expression of the above-indicated PKP1 transcripts in cancerous lung samples relative to the normal samples. The number and percentage of samples that exhibit at least 7 fold over-expression, out of the total number of samples tested is indicated in the bottom.

As is evident from FIG. 61, the expression of PKP1 transcripts detectable by SEQ ID NO:1600 in cancer samples originate from lung carcinoma was significantly higher than in the non-cancerous samples (Sample Nos. 46-50, 90-93, 96-99, Table 2, "Tissue samples in testing panel"). Notably an over-expression of at least 7 fold was found in 11 out of 16 squamous cell carcinoma samples, and in 1 out of 4 large cell carcinoma.

Statistical analysis was applied to verify the significance of these results, as described below.

The P value for the difference in the expression levels of PKP1 transcripts detectable by SEQ ID NO: 1600 in lung cancer samples versus the normal lung samples was determined by T test as 3.18E-03.

Threshold of 7 fold overexpression was found to differentiate between cancer and normal samples with P value of 3.50E-02 as checked by exact fisher test.

The above values demonstrate statistical significance of the results.

According to the present invention, PKP1 is a non-limiting example of a marker for diagnosing lung cancer. The PKP1 marker of the present invention, can be used alone or in combination, for various uses, including but not limited to, prognosis, prediction, screening, early diagnosis, therapy selection and treatment monitoring of lung cancer. Although optionally any method may be used to detected overexpression and/or differential expression of this marker, preferably a NAT-based technology is used. Therefore, optionally and preferably, any nucleic acid molecule capable of selectively hybridizing to PKP1 as previously defined is also encompassed within the present invention. Primer pairs are also optionally and preferably encompassed within the present invention; for example, for the above experiment, the following primer pair was used as a non-limiting illustrative example only of a suitable primer pair: PKP1—forward primer (SEQ ID NO: 1598): CCCCAGACTCTGTGCACT-TCA; and PKP1—Reverse primer (SEQ ID NO: 1599): TGGGCTCTGCTCTGTCTFAGTGTA The present invention also preferably encompasses any amplicon obtained through the use of any suitable primer pair; for example, for the above experiment, the following amplicon was obtained as a non-limiting illustrative example only of a suitable amplicon: PKP1—amplicon (SEQ ID NO: 1600): CCCCAGACTCTGTGCACTTCAGACCAG-CAGCAGCAGGAGGGCTCCCGAGGGCCTTATGAG-AAAACCT GTGTGGACATCCCTTGGTGTACACTAA-GACAGAGCAGAGCCCA According to other preferred embodiments of the present invention, PKP1 or a fragment thereof comprises a biomarker for detecting lung cancer. Optionally and more preferably, PKP1 splice variants, as depicted in SEQ ID NO: 1601-1603 (e.g., variants no: 0, 5 and 6), or a fragment thereof comprise a biomarker for detecting lung cancer. Optionally and more preferably, the fragment of PKP1 comprises segment_TAA seg 34-SEQ ID NO: 1608. Also optionally and more preferably, any suitable method may be used for detecting a fragment such as PKP1_segment_TAA seg 34-SEQ ID NO: 1608 for example. Most preferably, NAT-based technology used, such as any nucleic acid molecule capable of specifically hybridizing with the fragment. Optionally and most preferably, a primer pair is used for obtaining the fragment.

According to other preferred embodiments of the present invention, PKP1 splice variants containing the unique segment_8 as depicted in SEQ ID NO: 1607, for example variant 6, as depicted in SEQ ID NO: 1603, are suitable as biomarkers for detecting lung cancer.

According to still other preferred embodiments, the present invention optionally and preferably encompasses any amino acid sequence or fragment thereof encoded by a nucleic acid sequence corresponding to PKP1 as described above, including but not limited to SEQ ID NOs: 1604-1606. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to PKP1 as described above, optionally for any application.

Combined expression of 12 sequences (SEQ ID NO: 1480, 1517, 1529, 1532, 1558, 1574, 1594, 1600, 1616, 1619, 1622, 1625) in normal and cancerous lung tissues.

Expression of several transcripts detectable by SEQ ID NOs: 1480, 1517, 1529, 1532, 1558, 1574, 1594, 1600, 1616, 1619, 1622, 1625 was measured by real time PCR (the expression of each SEQ ID was checked separately). In parallel the expression of four housekeeping genes—PBGD (GenBank Accession No. BC019323 (SEQ ID NO:1713); amplicon—SEQ ID NO:1471), HPRT1 (GenBank Accession No. NM_000194 (SEQ ID NO:1714); amplicon—SEQ ID NO:1468), Ubiquitin (GenBank Accession No. BC000449 (SEQ ID NO:1711); amplicon—SEQ ID NO:1474) and SDHA (GenBank Accession No. NM_004168 (SEQ ID NO:1712); amplicon—SEQ ID NO: 1477), was measured similarly. For each RT sample, the expression of SEQ ID NOs: 1480, 1517, 1529, 1532, 1558, 1574, 1594, 1600, 1616, 1619, 1622, 1625 was normalized to the geometric mean of the quantities of the housekeeping genes. The normalized quantity of each RT sample was then divided by the median of the quantities of the normal post-mortem (PM) samples (Sample Nos. 47-50, 90-93, 96-99, Table 2, "Tissue samples in testing panel", above), to obtain a value of fold up-regulation for each sample relative to median of the normal PM samples.

Figure 62A:
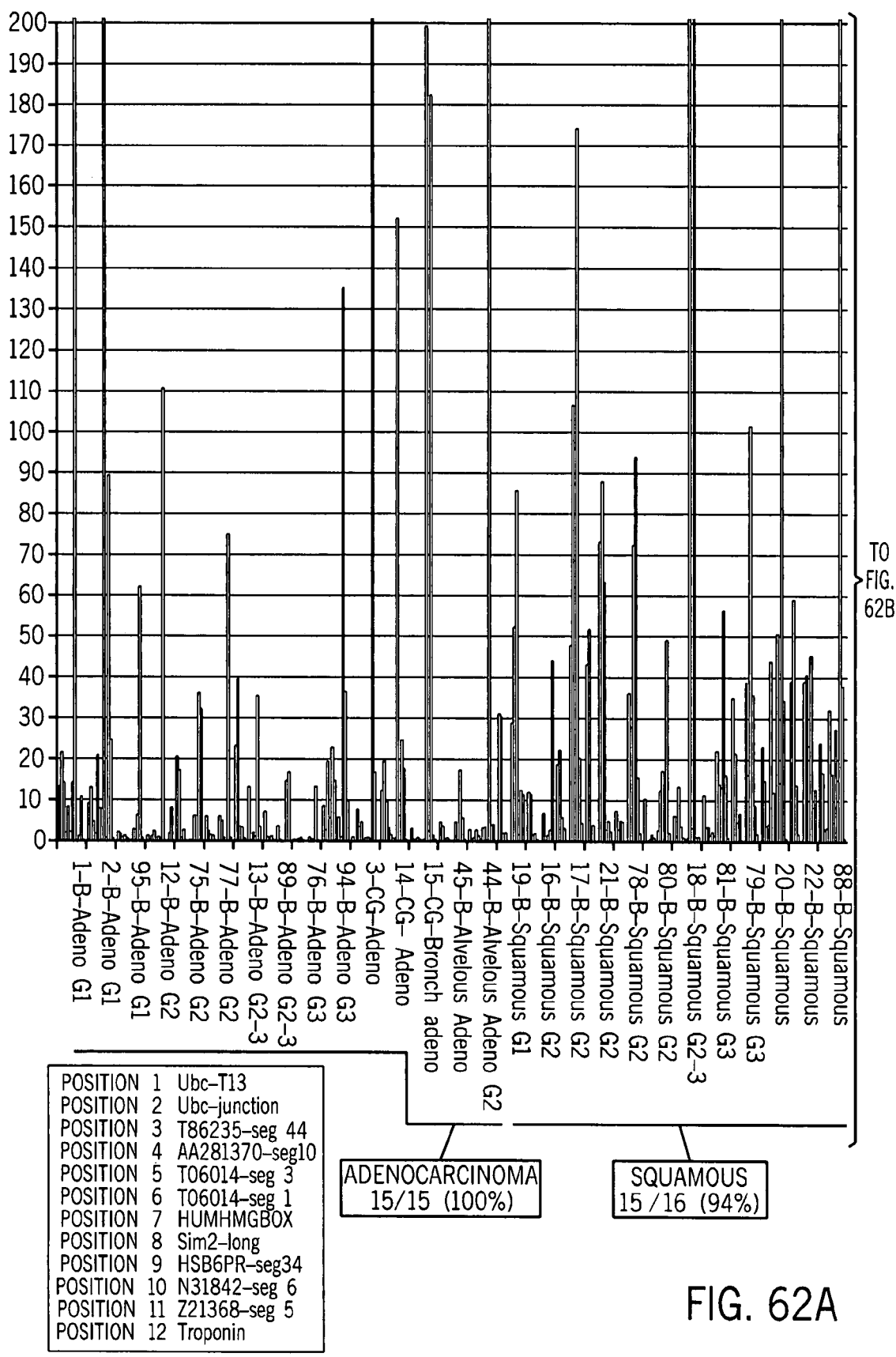
FIG. 62 is a histogram showing the relative expression of transcripts detectable by SEQ ID NOs: 1480, 1517, 1529, 1532, 1558, 1574, 1594, 1600, 1616, 1619, 1622, 1625 in normal and tumor derived lung samples as determined by real time PCR.
Figure 62B:
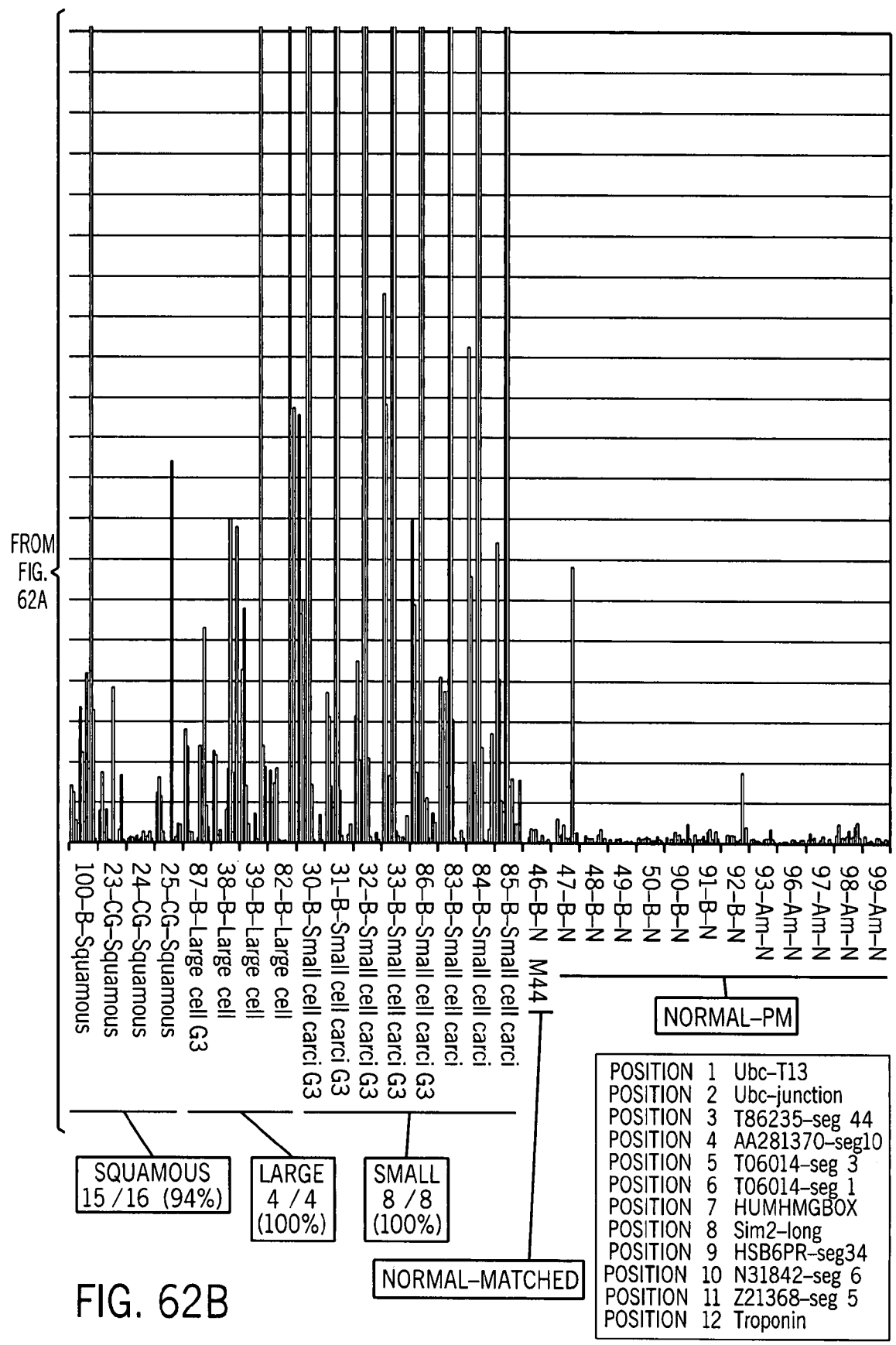

FIG. 62 is a histogram showing over expression of the above-indicated transcripts in cancerous lung samples relative to the normal samples. The number and percentage of samples that exhibit at least 10 fold over-expression of at least one of the SEQ IDs, out of the total number of samples tested is indicated in the bottom.

As is evident from FIG. 62, an over-expression of at least 10 fold in at least one of the SEQ IDs was found in 15 out of 15 adenocarcinoma samples, 15 out of 16 squamous cell carcinoma samples, 4 out of 4 large cell carcinoma samples, and in 8 out of 8 small-cell samples.

Statistical analysis was applied to verify the significance of these results, as described below. Threshold of 10 fold overexpression of at least one of the amplicons as depicted in SEQ ID NOs: 1480, 1517, 1529, 1532, 1558, 1574, 1594, 1600, 1616, 1619, 1622, 1625, was found to differentiate between cancer and normal samples with P value of 2.37E-08 as checked by exact fisher test.

The above values demonstrate statistical significance of the results.

Kits and Diagnostic Assays and Methods

The markers described with regard to any of Examples above can be used alone, in combination with other markers described above, and/or with other entirely different markers, including but not limited to UbcH10 (see U.S. Patent Application Nos. 60/535,904 and 60/572,122; filed on Jan. 13 and May 19, 2004, respectively), Troponin (see U.S. Patent Application No. 60/539,129; Sim2 (see PCT Application No. WO 2004/012847), PE-10 (SP-A), TTF-1, Cytokeratin 5/6, to aid in the diagnosis of lung cancer. All of these applications are hereby incorporated by reference as if fully set forth herein. These markers can be used in combination with other markers for a number of uses, including but not limited to, prognosis, prediction, screening, early diagnosis, therapy selection and treatment monitoring of lung cancer, and also optionally including staging of the disease. Used together, they may provide more information for the diagnostician, increasing the percentage of true positive and true negative diagnoses and decreasing the percentage of false positive or false negative diagnoses, as compared to the results obtained with a single marker alone.

Assays and methods according to the present invention, as described above, include but are not limited to, immunoassays, hybridization assays and NAT-based assays. The combination of the markers of the present invention with other markers described above, and/or with other entirely different markers to aid in the diagnosis of lung cancer could be carried out as a mix of NAT-based assays, immunoassays and hybridization assays. According to preferred embodiments of the present invention, the assays are NAT-based assays, as described for example with regard to the Examples above.

In yet another aspect, the present invention provides kits for aiding a diagnosis of lung cancer, wherein the kits can be used to detect the markers of the present invention. For example, the kits can be used to detect any one or combination of markers described above, which markers are differentially present in samples of a lung cancer patients and normal patients. The kits of the invention have many applications. For example, the kits can be used to differentiate if a subject has a small cell lung cancer, non-small cell lung cancer, adenocarcinoma, bronchoalveolar-alveolar, squamous cell or large cell carcinomas or has a negative diagnosis, thus aiding a lung cancer diagnosis. In another example, the kits can be used to identify compounds that modulate expression of the markers in in vitro lung cells or in vivo animal models for lung cancer.

In one embodiment, a kit comprises: (a) a substrate comprising an adsorbent thereon, wherein the adsorbent is suitable for binding a marker, and (b) a washing solution or instructions for making a washing solution, wherein the combination of the adsorbent and the washing solution allows detection of the marker as previously described.

Optionally, the kit can further comprise instructions for suitable operational parameters in the form of a label or a separate insert. For example, the kit may have standard instructions informing a consumer/kit user how to wash the probe after a sample of seminal plasma or other tissue sample is contacted on the probe.

In another embodiment, a kit comprises (a) an antibody that specifically binds to a marker; and (b) a detection reagent. Such kits can be prepared from the materials described above.

In either embodiment, the kit may optionally further comprise a standard or control information, and/or a control amount of material, so that the test sample can be compared with the control information standard and/or control amount to determine if the test amount of a marker detected in a sample is a diagnostic amount consistent with a diagnosis of lung cancer.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

---

SEQUENCE LISTING (1801 sequences)

SEQ ID NO: 1 - DNA, 1205 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 2 - DNA, 715 bp, Homo sapiens
ggaggcgctcggggcatccgaggcggggaggcgggtccgccccctattgtgtagcggcgagagtggagccgagcggtgcggagcagatctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggataagagttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 3 - DNA, 2875 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 4 - DNA, 1182 bp, Homo sapiens
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 5 - DNA, 2199 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 6 - DNA, 1947 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 7 - DNA, 1592 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 8 - DNA, 2490 bp, Homo sapiens
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgaaaaaaaagckataat

SEQ ID NO: 9 - DNA, 4755 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 10 - DNA, 4677 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 11 - DNA, 2790 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 12 - DNA, 3069 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 13 - DNA, 5384 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 14 - DNA, 4524 bp, Homo sapiens
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 15 - DNA, 4454 bp, Homo sapiens
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 16 - DNA, 3322 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 17 - DNA, 2817 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 18 - DNA, 248 bp, Artificial
  Synthetic oligonucleotide
gccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagc

SEQ ID NO: 19 - DNA, 285 bp, Artificial
  Synthetic oligonucleotide
cacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatcc

SEQ ID NO: 20 - DNA, 1362 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 21 - DNA, 1376 bp, Homo sapiens
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagatgtaggttcaaaaggcaaagactctctgctccaggttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 22 - DNA, 902 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggcacggtggctcacgcctgtaatcccagcactttgggaggccgagacgggcggatcacgaggtcaagagatggagaccatcccggctaacacgttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatg

SEQ ID NO: 23 - DNA, 1239 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 24 - DNA, 1020 bp, Homo sapiens
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 25 - DNA, 1737 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 26 - DNA, 1820 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 27 - DNA, 1970 bp, Homo sapiens
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 28 - DNA, 1745 bp, Homo sapiens
ttatgctcccgcggaggccaagcggactccctgacaggacagaatctgaacgtgagagtgaaggtcttgcctgtccagaaactcttgtagccagcacaggtttaaacaagaagccaaattgttctggagagattgctgggggctttctttgtgcctcaagcttcttcagtgccctgagcacaggaaacactcaagcagagaagcagagccaaacccaggatacgggaggtcgaggctcttccgtagacctgcagcattggggtgggatgatgttcattctgtgtgtgttctggaccaagcccctctccagggacctatgggcagccccctttaagcaagatgcccggtggagtgggcatccaccatcacttaccctgggcttgggtgaatagattttccgtgccttaaatgggcagggagggggtaaacatggacggtccattggtacaaataaaagcctttggtgggttttgatcaattgcaaggatcgaaggagacctgtggacctgaggtcaactggcagcagagaagagtctgggttcgtgaaggcgccgccgcggtgccgcgccacgtatttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatcccggccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaaggtaagccttccctcttgcttccccactccctgctgggctgagacgctcccaggagatcccgcccctgccacgcatcccagtgcatccctgcttggggtgccagtagcgggaagggcagaagttctgcctgacctggtctgtcatcacaacaagcctgtatcaaatttgaggcacccctcccacgccgcccaagtctcgcgcattctcctcccgagttgtaccagctatacttaagggcagtttaaaaataaaacaaacaaacaaaaacaacaaaactaaaaaaacgaagaactgaacggcggtttaaaaaaaaatagatacacgattattgttaaagatgctagcactggagctgcgcagagcgttggaagtggtgtttggtggagg

SEQ ID NO: 29 - DNA, 3170 bp, Homo sapiens
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 30 - DNA, 4161 bp, Homo sapiens
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 31 - DNA, 2546 bp, Homo sapiens
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcagggagttcatcccaaaatgatcagtaatctgcaagtgttcgccataggcccacagtgctccaaggtggaagtggtgtaagttctgtgctgctgtgtccgctgtgaccttggcaagagagaaatcccgcagcctgggtcttcaaccttggtatctcatgagtgtatcttctttttctttccttcagagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 32 - DNA, 1893 bp, Homo sapiens
gacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggca

SEQ ID NO: 33 - DNA, 1069 bp, Homo sapiens
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccagtctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaat

SEQ ID NO: 34 - DNA, 1507 bp, Homo sapiens
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcctacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 35 - DNA, 4902 bp, Homo sapiens
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccagcagagccggaaggcgcgccccgggcagagaaagccgagcagagctgggtggcgtctccgggccgccgctccgacgggccagcgccctccccatgtccctgctcccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcaggtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccacactctgtcaccctccaggccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagattaaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaccaaaattctaga

SEQ ID NO: 36 - DNA, 3429 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 37 - DNA, 5165 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 38 - DNA, 3575 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagaagtaagagaaacctgtgatggccagagcccagatgttcttaggaggcaagccaggagaagccgggtctgacttttcagctcagagacagcactcccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 39 - DNA, 2397 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagca

SEQ ID NO: 40 - DNA, 2206 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagctactgtggttgagaggaaaggtgtctttttattgcttctagagacgttgaaagtgtgacctgagcacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 41 - DNA, 1173 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 42 - DNA, 1104 bp, Homo sapiens
gcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 43 - DNA, 1105 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggaagttcaggtcgccatcataaacaactctatgtgcaaccacctcttcctcaagtacagtttccgcaaggacatctttggagacatgggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 44 - DNA, 1466 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagggttgctgtctctctccttcccactatcgtccgcacagcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccctgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 45 - DNA, 1354 bp, Homo sapiens
gcacacacgcgaggggaccctgggtgggcaaaaacgtgctttcccggacggggttgaaggggagaaagggagaggtcgggcttggggggctgcctcccgcggctcagcagttcctctgaccatccgaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaactgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggcactgccatctccccacaccctccaggaagttcaggtcgccatcataaacaactctatgtgcaaccacctcttcctcaagtacagtttccgcaaggacatctttggagacatggtttgtgctggcaatgcccaaggcgggaaggatgcctgcttcgtgagtgtccctgccaccactcccagcccaggaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccagggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 46 - DNA, 1171 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagacgccaaggagcaacacacgcaccagggtaggctggagaaaccagaacccgggaatcccgcctccctcaacttgaaacttgggaatagtgtattctcttttcaacacttgcactagtagaaggttaattacatgaaagattaggcaaaatgtatggctatgtgtcctggttttccaataaaagtattgagtttctctggggaaagtgcagataaaatgcttagtggaggctgggcgctgtggcttatgcctgtaatcccagcactttgggaggccgaggcaggcaggcagatcacaaggtcaggagtttgagaccggcctggccaatatgatg

SEQ ID NO: 47 - DNA, 953 bp, Homo sapiens
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccggagtcgcaggaggcggcgcccttatcaggaccatgcggccgacgggtcatcacgtcgcgcatcgtgggtggagaggacgccgaactcgggcgttggccgtggcaggggagcctgcgcctgtgggattcccacgtatgcggagtgagcctgctcagccaccgctgggcactcacggcggcgcactgctttgaaacctatagtgaccttagtgatccctccgggtggatggtccagtttggccagctgacttccatgccatccttctggagcctgcaggcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgaggtgctcaccaatgccccaggcatcaggctcctgggctgcctctccatgcctcccacacccaccctagctctggccgattctcctgcagcactgagcccattcctctccccagaaacttccaagccatgctcaaccgcagctcccacggaaacccctctgggggttcctctggtgggcctgccctggcacctgcgtgtcccccaacacacatgccctgaaagaagtgggcccagcatccggaggagccccggcagccccagactgggcgtgttccctgtatcaggaatcccttccctct

SEQ ID NO: 48 - DNA, 3110 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacaggtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagcccacccacctcagtcagagaaccaggaccccaaaggcatgcagagcccccacttccccactgtcttggccagccagggaccccagaagagaggttacaacccttcaggaatagggacaagctgctccctttgtaagaggatgtgagggaggctggctgggcccctgccagcaaacacaaatgaccctgcggcctggctcttctctctcctcccagctgcggcccttgcagctctgctcctggcacagagacaggagctactggctgagtgtaacagctggagggatggagggggaggggaggacgctccactccacgccagacagccccttctgcttgcaaatgagttagatccccatgcttctcctttcttctctccctcactcagtatcctcactcgaaagtctttgatgctggaaggtcatcccagccattctgctgctgctacacaggcccagccctaaacaaaataaccggggttctttggtcccaaaagatccccaggaaagagtaaacctccttaagacttaaggaaaaaagttggctaggcgtggtggctcacacctgtaatcccagcactttgggaggccgaggtgggcagaccacttgagatcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtcccgcaaaaaaaaaaaaaaaaaa

SEQ ID NO: 49 - DNA, 1903 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctgaggagagacttcacctgggacgtgaaaggagcatgggcttgatgtcagacagctgtgaccctggacagggccccccccaccatctgtaaaacggggacagtatgatgtaccttgaagggctgttgtcagaattctacgtgatgtaagtcaagcacctagcacagatcagtctgtcaataaatggccaatgttccgtgattattaccctgacc

SEQ ID NO: 50 - DNA, 2364 bp, Homo sapiens
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctaaccagcccctccccgcacgccccctgcccaccccccacctcccactccaggagctgaacagagacttgcccagctgcccaaagccagccccgaactcctggggggccaggggagcccagggcagccacgacttggctttgtgttttatttcctc

SEQ ID NO: 51 - DNA, 3125 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccagggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 52 - DNA, 3263 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 53 - DNA, 3256 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 54 - DNA, 3164 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 55 - DNA, 2886 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 56 - DNA, 3100 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcaggtgtgggcagcgacaggtcgcagggtggcaagggtgggcatgctctcactttgagaaggccctgactctggctcccacctcgcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 57 - DNA, 3254 bp, Homo sapiens
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatggtaaggctggggtgtgaggatggaggaagaaaggaggggtgaactgggcgggcccagactgagcggggtgctcccacccacagagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgccctgaggagcaatgttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcaggcccagtccctaccttgatcgtgagaaaggcgatgtgggagaactccttcacgaagccggcaatctgctccccgctgtccccgtacttcactaaccagggccggcgctgcacctccatctgccccaccaggaaagacatcagcctacagcagctgcatccttgctcacagctaccagcaagaccttagggctgggaattcctccacacttgccctctgtgggccagagccaggcagccagctggccactcccaggcatacccgctcccaatcctccacagcagcccctatcccagggccaggaatctctaccttaccttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 58 - DNA, 1533 bp, Homo sapiens
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcag

SEQ ID NO: 59 - DNA, 6659 bp, Homo sapiens
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 60 - DNA, 6333 bp, Homo sapiens
ggctgcagtggccgccgctggagaccgcgggacctggcgctgcagcgagattttcaaacaccgcattccccttaaacctcccaggctcccatcactcccagcaaagagccagcccgctactttatggagacaggagagactgtcagacagttcctgctgctgcccaggtgcatctgagagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 61 - DNA, 6297 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 62 - DNA, 3466 bp, Homo sapiens
tcctgagctcaggcaacctgcccgcctcggcctcccagagtgctgggattacaggcatgagccacggtgcccagcccagatgggttctcactttattgttcaagctggtctgaaactcctggcctcgagcaagcctcccaagtgctgggattacagggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 63 - DNA, 3580 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 64 - DNA, 1786 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 65 - DNA, 7128 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatgattttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccaggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 66 - DNA, 7004 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 67 - DNA, 5977 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 68 - DNA, 5999 bp, Homo sapiens
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 69 - DNA, 6038 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 70 - DNA, 5044 bp, Homo sapiens
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcagtttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 71 - DNA, 2945 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggagtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 72 - DNA, 2261 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgaggtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 73 - DNA, 1059 bp, Homo sapiens
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcagtttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaagtgagttctctttgtctgaatgggactgagaagaaaatcaaagatggcagggaagaatcattttcagttgaaatatcacttgcttaagtcggggctggttatgcttaaaaattaattactgcacaccagagaatgt

SEQ ID NO: 74 - DNA, 2715 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 75 - DNA, 2931 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 76 - DNA, 3190 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatggtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcagacacccccatgacccttccaaaaggtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 77 - DNA, 2385 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 78 - DNA, 2577 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggtaagaggaggaacagccgggtacctaggggaagagaccagaggtcagcggccaggctgtgattcccaaagccacacaggaccctcaaagaagccctctgccccatctcctctccctgcaggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 79 - DNA, 2297 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 80 - DNA, 2457 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 81 - DNA, 4104 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgctcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacaggtgcatacccaccttcaagtgattgaggagagggtgaatcagagcctgggcctgcttgaccagaacccccacctggctcaggagctgcggccccaaatccgtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 82 - DNA, 1795 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 83 - DNA, 2175 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 84 - DNA, 1956 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 85 - DNA, 1804 bp, Homo sapiens
ttttgagacagagtcttgctctgttgcctaggctaaagtgcagtagtgcgatctcggctcactgcaacctccacttcctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 86 - DNA, 838 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 87 - DNA, 606 bp, Homo sapiens
tccgggcgcggaggtttgcgcgccttggtgagccgttggcgtggtggtcccggagtgatcctggcagccggtggggaagacaaggagggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 88 - DNA, 698 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 89 - DNA, 733 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 90 - DNA, 746 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 91 - DNA, 782 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 92 - DNA, 627 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 93 - DNA, 917 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 94 - DNA, 952 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 95 - DNA, 1001 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 96 - DNA, 846 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 97 - DNA, 4539 bp, Homo sapiens
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggagctggacaatcacggccggcgactgctcctcagtgaggaggcgtcactcaatatccctgcagtggcggccgcccatgtgatcaaacggtatacagcccaggcgccagatgagctgtcctttgaggtgggagacattgtctcggtgatcgacatgccacccacagaggatcggagctggtggcggggcaagcgaggcttccaggtcgggttcttccccagtgagtgtgtggaactcttcacagagcggccaggtccgggcctgaaggcggatgccgatggccccccatgtggcatcccggctccccagggtatctcgtctctgacctcagctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatgtgccccaggtgctgcgctgctgctccgagttcattgaggcccacggggtggtggatgggatctaccggctctcaggcgtgtcttccaacatccagaggcttcggcacgagtttgacagtgagaggatcccggagctgtctggccctgcattcctgcaggacatccacagcgtgtcctccctctgcaagctctacttccgagagcttccgaaccctctgctcacctaccagctctatgggaagttcagtgaggccatgtcagtgcctggggaggaggagcgtctggtgcgggtgcacgatgtcatccagcagctgcccccaccacattacaggaccctggagtacctgctgaggcacctggcccgcatggcgagacacagtgccaacaccagcatgcatgcccgcaacctggccattgtctgggcacccaacctgctacggtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcaggccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaaggaggaaaggggagagaggggagaagcagcggaagccagggggcagcagctggaagacgttctttgcactgggccggggccccagtgtccctcgaaagaagcccctgccctggctggggggcacccgtgccccaccgcagccttcaggcagcagacccgacaccgtcacactgagatctgccaagagcgaggagtctctgtcatcgcaggccagcggggctggcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcaccccccgcccctgcctctgccttcccacccagggtgaccccccaggccatctcgccccgggggcccaccagccccgcctcgcctgctgccctagacatctcagagcccctggctgtatcagtgccacccgctgtcctagaactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcggtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccaggtcagtgcccagctcagggcaggtggcgggggcagggatgcgccagaggcagcagcccagtccccatgttctgtcccctcacaggttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacaggtcccccgacttcctgctcagctacccgccagccccctcctgctttccccctgaccaccttggctactcagccccccagcaccctgctcggcgccctacaccgcctgagcccctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacagggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctccctccaggagcccccagcatgtcctgacctgtgcacggggatggggggacaactcctacccttctttccccacatgccccactaaaccatctgacaacattaatgaataaaatggtgaaaatgtga

SEQ ID NO: 98 - DNA, 968 bp, Homo sapiens
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacaggcacgcagcactgacagcctggatggcccaggggagggctcggtgcagcctctacccactgctggggggcccagtgtgaaggggaagcctgggaagaggctctcagctcctcgaggccccttcccgcggctggctgactgcgcccatttccactacgagaacgttgactttggccacattcagctcctgctgtctccagaccgtgaagggcccagcctctctggagagaatgagctggtgttcggggtgcaggtgacctgtcagggccgttcctggccggttctccggagttacgatgactttcgttccctggatgcccacctccaccggtgcatatttgaccggaggttctcctgccttccggagcttcccccgccccccgagggtgccagggctgcccagatgctggtgccactgctgctgcagtacctggagacactgtcaggactggtggacagtaacctcaactgcgggcctgtgctcacctggatggaggtgggcctgggcagggggcttggagattccgagtgggtgagggggtgcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 99 - DNA, 3615 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttgtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 100 - DNA, 2648 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcata

SEQ ID NO: 101 - DNA, 3475 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaagtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacagatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 102 - DNA, 1271 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttc

SEQ ID NO: 103 - DNA, 1225 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 104 - DNA, 1210 bp, Homo sapiens
tgtctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 105 - DNA, 1192 bp, Homo sapiens
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 106 - DNA, 1177 bp, Homo sapiens
cttggctggaggctctgcgaggacagctggggagaaggggagctgtgatggaggctcgctctgttgccaggctggagtacagcgatctcggctcactgcaacctctgcctcccgggttcaagtgattctcctgcctcagcctcccaagtagctgggactacagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 107 - DNA, 1051 bp, Homo sapiens
gccttatttctctgctggttgagcgaagggattgtcttccatggtctccgagatcccgtcccacgctcatgccctagaattctctgagtccttgatgcacttttgcctttggcgaggaggcaggacagtcaggcgtggaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 108 - DNA, 1267 bp, Homo sapiens
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 109 - DNA, 3897 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctgtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccagatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 110 - DNA, 3347 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctggtaagtggctccctggagcatcagcatcatattctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 111 - DNA, 1886 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 112 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 113 - DNA, 2429 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 114 - DNA, 3898 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 115 - DNA, 3774 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 116 - DNA, 3998 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggagctgggcctggcccccgatatgttcttctgcctgcgcctcctggaggagaccggcatctgcgtggtgccagggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 117 - DNA, 4071 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggcagggggggccgggcatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 118 - DNA, 4138 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcgtgaccactgccgccctcgtgcgctctgtgtcatcaaccctggcaaccccaccgggcaggtgcagacccgcgagtgcatcgaggccgtgatccgcttcgccttcgaagagcggctctttctgctggcggacgaggtgcgcggcgcgggggagcgggaagccgggcaacagtccgcccccgtgacgccttgcgcccttccaggtgtaccaggacaacgtgtacgccgcgggttcgcagttccactcattcaagaaggtgctcatggagatggggccgccctacgccgggcagcaggagcttgcctccttccactccacctccaagggctacatgggcgagtgcgtgcgtacgaggcgggtgggggctcgcgggccatggccaggccctcctcgcccgatgggccaccccctcctccgcacctgacctggccgtgcgcaggtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggctgagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcaggtcaggcgggggcggggcctgcggggtgggcagggggggccgggcatccctctctgacggctctccgtccacaggagctgggcctggcccccgatatgttcttctgcctgcgcctcctggaggagaccggcatctgcgtggtgccagggagcggctttgggcagcgggaaggcacctaccacttccggtgaggcctggccctcactccctgtcccgccaccctggcccttcactcactgtcaactcctttcaggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 119 - DNA, 1250 bp, Homo sapiens
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtagagtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccagggtgtgaagaagcctttcaccgaggtcatccgtgccaacatcggggacgcacaggctatggggcagaggcccatcaccttcctgcgccaggtcttggccctctgtgttaaccctgatcttctgagcagccccaacttccctgacgatgccaagaaaagggcggagcgcatcttgcaggcgtgtgggggccacagtctgggggcctacagcgtcagctccggcatccagctgatccgggaggacgtggcgcggtacattgagaggcgtgacggaggcatccctgcggaccccaacaacgtcttcctgtccacaggggccagcgatgccatcgtgacggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgcggagcggctttgggcagcgggaaggcacctaccacttccggatgaccattctgccccccttggagaaactgcggctgctgctggagaagctgagcaggttccatgccaagttcaccctcgagtactcctgagcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtc

SEQ ID NO: 120 - DNA, 1292 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 121 - DNA, 886 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 122 - DNA, 696 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaaggctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 123 - DNA, 706 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaagaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 124 - DNA, 560 bp, Homo sapiens
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 125 - DNA, 3194 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 126 - DNA, 2705 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 127 - DNA, 3332 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 128 - DNA, 3052 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 129 - DNA, 2359 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 130 - DNA, 2077 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 131 - DNA, 1266 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtggaaagtgcatcttcctaagggcgagggtttcagcagtggttgaactcggcggggtggggcggagcgggaggatgcaaacttgcaaagtgaagcaaacacactcaccgcagcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 132 - DNA, 747 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccga

SEQ ID NO: 133 - DNA, 2201 bp, Homo sapiens
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacagctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 134 - DNA, 5503 bp, Homo sapiens
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaatgctacaagatagaaattactatgcccaagaggaggaaagtgaagctaagagattagagaactcggactgagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 135 - DNA, 1919 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacacttgcttccttctcccacatgtcagatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 136 - DNA, 1743 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 137 - DNA, 1749 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 138 - DNA, 1769 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 139 - DNA, 1522 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaaaaagatctcgctctgttgcccaggctggagtgcagtggtgtgatcacgactcaccgcagccttgacctcccacactcaagcaatcctcctgccttagccttccaagtagctggaactccaggtggtggttaattttatgtgtcaacctggctggaccactgggtactccgatatttggtcaaacattattctgag

SEQ ID NO: 140 - DNA, 1414 bp, Homo sapiens
ggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 141 - DNA, 1846 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 142 - DNA, 1769 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaactttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaga

SEQ ID NO: 143 - DNA, 378 bp, Homo sapiens
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcaggtaagcatcttttatgtttttatatagttaaatcatttactcaattatggcgagaggtgcaagaaacgtatttgctgcgatattact

SEQ ID NO: 144 - DNA, 1295 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 145 - DNA, 1367 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 146 - DNA, 1520 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 147 - DNA, 1371 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 148 - DNA, 2213 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 149 - DNA, 2247 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 150 - DNA, 876 bp, Homo sapiens
gtggaggaggatggtggggagtggtggtgtcttcgtcctgggagaaggcgaagcaacttccaggaggaaacgggcgtttccttcccacgcgctcgagcgagccctgggtcctggcctcggaactccacccagcccctccccaccctctgggaaaagccagtcgccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaagggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccagtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacgggtaatcctgctccctctgctgtttgacctcttctcctgcagctaagtgaagctgcttcctcccttctcttttgtattccccttcccagagggcgataagcaaataataataatgcaataaat

SEQ ID NO: 151 - DNA, 232 bp, Artificial
  Synthetic oligonucleotide
atctggtggttctccggagagcagcttccttgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacg

SEQ ID NO: 152 - DNA, 189 bp, Artificial
  Synthetic oligonucleotide
gtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgg

SEQ ID NO: 153 - DNA, 201 bp, Artificial
  Synthetic oligonucleotide
gttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagatgtcattcatttacacacacacaca

SEQ ID NO: 154 - DNA, 698 bp, Artificial
  Synthetic oligonucleotide
gtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagcagtccagctgtcacagaaaagctaggacatgcagtatgcttctttggatattctgagtaacatttggactgttacccattggctaccagcatctcccaagtgagaatacatagattacccccagtgccctgaacagcactcggtcctaacacccgtgtccatggaaagcacgccgcgtctggagaaagaagccgaaggctcttgtcacttactagccatgtgattttggaaagaaacttaacattaattccttcagctacaatggaattcttgggaggattaaatatggtgacaacgcctaatattagatggcctgtattccacactcaatcttccttccctcttcttccttctttgtagagctataatgaaaagtatcatgtgggacacagaagaggttgcagtctggggtctgcagggcttagcggccaggcagattagctttcttgaggaatcctgacagtgggtggaagggtatgatgatg

SEQ ID NO: 155 - DNA, 86 bp, Artificial
  Synthetic oligonucleotide
ggaggcgctcggggcatccgaggcggggaggcgggtccgccccctattgtgtagcggcgagagtggagccgagcggtgcggagcag

SEQ ID NO: 156 - DNA, 7 bp, Artificial
  Synthetic oligonucleotide
gataaga

SEQ ID NO: 157 - DNA, 203 bp, Artificial
  Synthetic oligonucleotide
tctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaag

SEQ ID NO: 158 - DNA, 229 bp, Artificial
  Synthetic oligonucleotide
agagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaattta

SEQ ID NO: 159 - DNA, 336 bp, Artificial
  Synthetic oligonucleotide
ccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcag

SEQ ID NO: 160 - DNA, 125 bp, Artificial
  Synthetic oligonucleotide
ctccatcggcagtgtccatcatgcatcaggtgagccgcaccgtggacagcattaccctgtcgtggtcccagccagaccagcccaatggcgtgatcctggactatgagctgcagtactatgagaag

SEQ ID NO: 161 - DNA, 1305 bp, Artificial
  Synthetic oligonucleotide
gtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatccc

SEQ ID NO: 162 - DNA, 404 bp, Artificial
  Synthetic oligonucleotide
tgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggc

SEQ ID NO: 163 - DNA, 184 bp, Artificial
  Synthetic oligonucleotide
cttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaag

SEQ ID NO: 164 - DNA, 97 bp, Artificial
  Synthetic oligonucleotide
ctctactgtaacggggacggcgagtggctggtgcccatcgggcgctgcatgtgcaaagcaggcttcgaggccgttgagaatggcaccgtctgccgag

SEQ ID NO: 165 - DNA, 91 bp, Artificial
  Synthetic oligonucleotide
gttgtccatctgggactttcaaggccaaccaaggggatgaggcctgtacccactgtcccatcaacagccggaccacttctgaaggggccac

SEQ ID NO: 166 - DNA, 65 bp, Artificial
  Synthetic oligonucleotide
caactgtgtctgccgcaatggctactacagagcagacctggaccccctggacatgccctgcacaa

SEQ ID NO: 167 - DNA, 65 bp, Artificial
  Synthetic oligonucleotide
aaacgctaatggactccactacagcgactgctgagctgggctggatggtgcatcctccatcaggg

SEQ ID NO: 168 - DNA, 810 bp, Artificial
  Synthetic oligonucleotide
gagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctgg

SEQ ID NO: 169 - DNA, 168 bp, Artificial
  Synthetic oligonucleotide
gtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacct

SEQ ID NO: 170 - DNA, 157 bp, Artificial
  Synthetic oligonucleotide
ggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagg

SEQ ID NO: 171 - DNA, 198 bp, Artificial
  Synthetic oligonucleotide
agtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcg

SEQ ID NO: 172 - DNA, 153 bp, Artificial
  Synthetic oligonucleotide
ggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctg

SEQ ID NO: 173 - DNA, 140 bp, Artificial
  Synthetic oligonucleotide
gccatcccgcgccacgtggctgtccttgttctccagtgaggagagcaacttgggagccaacaactatgatgactacaggatggactggcttgtgcctgccacctgtgaacccatccagagtgtcttcttcttctctggag

SEQ ID NO: 174 - DNA, 127 bp, Artificial
  Synthetic oligonucleotide
acaagtactaccgagtcaatcttcgcacacggcgagtggacactgtggaccctccctacccacgctccatcgctcagtactggctgggctgcccagctcctggccatctgtaggagtcagagcccac

SEQ ID NO: 175 - DNA, 223 bp, Artificial
  Synthetic oligonucleotide
tgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggataga

SEQ ID NO: 176 - DNA, 9 bp, Artificial
  Synthetic oligonucleotide
ctgaccaag

SEQ ID NO: 177 - DNA, 44 bp, Artificial
  Synthetic oligonucleotide
ggagacctcagcccccagcagaggaggagctgtgcagtgggaag

SEQ ID NO: 178 - DNA, 38 bp, Artificial
  Synthetic oligonucleotide
cccttcgacgccttcaccgacctcaagaacggttccct

SEQ ID NO: 179 - DNA, 14 bp, Artificial
  Synthetic oligonucleotide
ctttgccttccgag

SEQ ID NO: 180 - DNA, 32 bp, Artificial
  Synthetic oligonucleotide
ggcagtactgctatgaactggacgaaaaggca

SEQ ID NO: 181 - DNA, 24 bp, Artificial
  Synthetic oligonucleotide
gtgaggcctgggtaccccaagctc

SEQ ID NO: 182 - DNA, 84 bp, Artificial
  Synthetic oligonucleotide
atccgagatgtctggggcatcgagggccccatcgatgccgccttcacccgcatcaactgtcaggggaagacctacctcttcaag

SEQ ID NO: 183 - DNA, 42 bp, Artificial
  Synthetic oligonucleotide
ctggtaccagacagccccagttcattagccgggactggcacg

SEQ ID NO: 184 - DNA, 51 bp, Artificial
  Synthetic oligonucleotide
gtgtgccagggcaagtggacgcagccatggctggccgcatctacatctcag

SEQ ID NO: 185 - DNA, 9 bp, Artificial
  Synthetic oligonucleotide
gcatggcac

SEQ ID NO: 186 - DNA, 95 bp, Artificial
  Synthetic oligonucleotide
cccgcccctccttggccaagaaacaaaggtttaggcatcgcaaccgcaaaggctaccgttcacaacgaggccacagccgtggccgcaaccagaac

SEQ ID NO: 187 - DNA, 42 bp, Artificial
  Synthetic oligonucleotide
agtcatgcaagggccgctgcactgagggcttcaacgtggaca

SEQ ID NO: 188 - DNA, 8 bp, Artificial
  Synthetic oligonucleotide
tcccgccg

SEQ ID NO: 189 - DNA, 7 bp, Artificial
  Synthetic oligonucleotide
atggccg

SEQ ID NO: 190 - DNA, 17 bp, Artificial
  Synthetic oligonucleotide
ggccctctgtagctccc

SEQ ID NO: 191 - DNA, 62 bp, Artificial
  Synthetic oligonucleotide
tcctcccatctccttcccccagcccaataaaggtcccttagccccgaaaaaaaagckataat

SEQ ID NO: 192 - DNA, 20 bp, Artificial
  Synthetic oligonucleotide
agaagtgccagtgtgacgag

SEQ ID NO: 193 - DNA, 58 bp, Artificial
  Synthetic oligonucleotide
ctctgctcttactaccagagctgctgcacagactatacggctgagtgcaagccccaag

SEQ ID NO: 194 - DNA, 6 bp, Artificial
  Synthetic oligonucleotide
ctcaag

SEQ ID NO: 195 - DNA, 20 bp, Artificial
  Synthetic oligonucleotide
gcctgagacccttcatccag

SEQ ID NO: 196 - DNA, 327 bp, Artificial
  Synthetic oligonucleotide
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcag

SEQ ID NO: 197 - DNA, 177 bp, Artificial
  Synthetic oligonucleotide
aactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaa

SEQ ID NO: 198 - DNA, 240 bp, Artificial
  Synthetic oligonucleotide
ggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacag

SEQ ID NO: 199 - DNA, 300 bp, Artificial
  Synthetic oligonucleotide
tcttcatcttgcgagcacttggcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggctttt

SEQ ID NO: 200 - DNA, 152 bp, Artificial
  Synthetic oligonucleotide
ccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaag

SEQ ID NO: 201 - DNA, 176 bp, Artificial
  Synthetic oligonucleotide
ctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaat

SEQ ID NO: 202 - DNA, 129 bp, Artificial
  Synthetic oligonucleotide
agtcccacagatcgttctcaacattgacttggcccccacgatcctggatattgctgggctcgacacacctcctgatgtggacggcaagtctgtcctcaaacttctggacccagaaaagccaggtaacag

SEQ ID NO: 203 - DNA, 279 bp, Artificial
  Synthetic oligonucleotide
gtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcag

SEQ ID NO: 204 - DNA, 50 bp, Homo sapiens
ccccagcttttatagagcggcccaaggaagaatatttccaagaagtaggg

SEQ ID NO: 205 - DNA, 50 bp, Homo sapiens
gacatctttgcatatcatgtcagagctataacatcattgtggagaagctc

SEQ ID NO: 206 - DNA, 50 bp, Homo sapiens
gtcatgaaaatcaacaccgaggtgcggagcttcggacctgtgtcccgcag

SEQ ID NO: 207 - DNA, 50 bp, Homo sapiens
agttcatccttcttcagtgtgaccagtaaattcttcccatactcttgaag

SEQ ID NO: 208 - DNA, 50 bp, Homo sapiens
gctgatatggaagttggggaatctgaattgccagagaatcttgggaagag

SEQ ID NO: 209 - DNA, 50 bp, Homo sapiens
tctcatagaagcaaaggagaacagaaaccaccagccacctcaacccaagg

SEQ ID NO: 210 - DNA, 50 bp, Homo sapiens
tctgacttttacggacttggcttgttagaaggctgaaagatgatggcagg

SEQ ID NO: 211 - DNA, 50 bp, Homo sapiens
acgggagggaaggaaggtgtgcgggaggagttctctgtctccactcccct

SEQ ID NO: 212 - DNA, 50 bp, Homo sapiens
caaggggaactgaccgttggtcccgaaggtctagaagtgaatgggagcag

SEQ ID NO: 213 - DNA, 50 bp, Homo sapiens
ctgggcttggacttcggagttttgccattgccagtgggacgtctgagact

SEQ ID NO: 214 - DNA, 50 bp, Homo sapiens
tcttagcaggtaggtgccgcagaccctgcgggttaagaggtggggtgggg

SEQ ID NO: 215 - DNA, 50 bp, Homo sapiens
cgtaattgcagtgcatttagacaggcatctatttggacctgtttctatct

SEQ ID NO: 216 - DNA, 50 bp, Homo sapiens
tgaagagtgtgaggaaaacctatgtttgccgcttaagctttcagctcagc

SEQ ID NO: 217 - DNA, 50 bp, Homo sapiens
ccaaggctcgtctgcgcaccttgtgtcttgtagggtatggtatgtgggac

SEQ ID NO: 218 - DNA, 50 bp, Homo sapiens
aaaagcatgagtttctgaccagcgttctggacgcgctgtccacggacatg

SEQ ID NO: 219 - DNA, 50 bp, Homo sapiens
atgttcttaggaggcaagccaggagaagccgggtctgacttttcagctca

SEQ ID NO: 220 - DNA, 50 bp, Homo sapiens
tcctccagacccaaagccacaacccatcgcaagtcaagaacactttccag

SEQ ID NO: 221 - DNA, 50 bp, Homo sapiens
accctgggtgggcaaaaacgtgctttcccggacggggttgaaggggagaa

SEQ ID NO: 222 - DNA, 50 bp, Homo sapiens
tggagactgttgccccactctgcagatgcagaaacggaggcttggctgct

SEQ ID NO: 223 - DNA, 50 bp, Homo sapiens
ccagtgtggtatcctgggaaactcggttaaaaggtgaggcagagtaccag

SEQ ID NO: 224 - DNA, 50 bp, Homo sapiens
aaggaagcaggaccagtggatgtgaggcgtggtcgaagaacaacagaaag

SEQ ID NO: 225 - DNA, 50 bp, Homo sapiens
acaggggccagatggtgacccatgacccagcctaaaaggcagccagaggg

SEQ ID NO: 226 - DNA, 50 bp, Homo sapiens
atcagcactgccacctacaccacggtgccgcgcgtggccttctacgccgg

SEQ ID NO: 227 - DNA, 50 bp, Homo sapiens
gtgaaaccccattggcttcattggctccttgatttaaaccacgcccggct

SEQ ID NO: 228 - DNA, 50 bp, Homo sapiens
tgagtccgtgttatatcatctggtctcattgataggcgggatagggaggg

SEQ ID NO: 229 - DNA, 50 bp, Homo sapiens
tttgtggaatagcaacccatggttatggcgagtgacccgacgtgatctgg

SEQ ID NO: 230 - DNA, 50 bp, Homo sapiens
aaggcttaggtgcaaagccattggataccatacctgagaccacacagcca

SEQ ID NO: 231 - DNA, 50 bp, Homo sapiens
accagaagcagctgtccagactccgagacgaaattgaggagaagcagaaa

SEQ ID NO: 232 - DNA, 50 bp, Homo sapiens
gagaagatgaacccgctggaacagtatgagcgaaaggtgaatgcgtctgt

SEQ ID NO: 233 - DNA, 50 bp, Homo sapiens
aactcacagcaagagctgtgttccagttagctttgctaccagttatgcag

SEQ ID NO: 234 - DNA, 50 bp, Homo sapiens
catttccactacgagaacgttgactttggccacattcagctcctgctgtc

SEQ ID NO: 235 - DNA, 50 bp, Homo sapiens
gctgcaatctaagtttcggaatacttataccactccagaaataatcctcg

SEQ ID NO: 236 - DNA, 50 bp, Homo sapiens
ttcagaactgttaacatcgctgacgggaagtggcatcgggtagcaatcag

SEQ ID NO: 237 - DNA, 50 bp, Homo sapiens
acaagatccccgtgaagtacctggagttcatctcggaatgcatcatccag

SEQ ID NO: 238 - DNA, 50 bp, Homo sapiens
taaacaatcaaagagcatgttggcctggtcctttgctaggtactgtagag

SEQ ID NO: 239 - DNA, 50 bp, Homo sapiens
tgcctcgccacaatggcacctgccctaaaatagcttcccatgtgagggct

SEQ ID NO: 240 - DNA, 50 bp, Homo sapiens
caagaggggtttggctgagactttaggattgtgattcagcttagagggac

SEQ ID NO: 241 - DNA, 50 bp, Homo sapiens
cctggtgggagcccatgagaagcgagttctctgtgcaacggacttagtaa

SEQ ID NO: 242 - DNA, 50 bp, Homo sapiens
gctccctggagcatcagcatcatattctggggtggagtctatctggttct

SEQ ID NO: 243 - DNA, 50 bp, Homo sapiens
tcctgcctgtcacctgaagttctagatcattccctggactccactctatc

SEQ ID NO: 244 - DNA, 50 bp, Homo sapiens
tttaacacaggattgggacaggattcagagggacactgtggcccttctac

SEQ ID NO: 245 - DNA, 50 bp, Homo sapiens
tatgtggaggtggtgaacatggacgctgcagtgcagcagcagatgctgaa

SEQ ID NO: 246 - DNA, 50 bp, Homo sapiens
aactctggcaccttgggctgtggaaggctctggaaagtccttcaaagctg

SEQ ID NO: 247 - DNA, 50 bp, Homo sapiens
atgagagtaacctcacccgtgcactagtttacagagcattcactgcccca

SEQ ID NO: 248 - DNA, 50 bp, Homo sapiens
cagagatgagagcctggagcattgcagatgccagggacttcacaaatgaa

SEQ ID NO: 249 - DNA, 50 bp, Homo sapiens
ctcaaaatgaaactccctctcgcagagcacaattccaattcgctctaaaa

SEQ ID NO: 250 - DNA, 50 bp, Homo sapiens
ccgcgttgcttctagaggctgaatgcctttcaaatggagaaggcttccat

SEQ ID NO: 251 - protein, 51 aa, Artificial
  Synthetic peptide
ALGVRQLVGGGHSSRFSHLVVAGLPHACHRKSGSSSQVLCPEPSALLSVAG

SEQ ID NO: 252 - protein, 24 aa, Artificial
  Synthetic peptide
ELGFPSSTGRDESLEHCRCQGLHK

SEQ ID NO: 253 - protein, 11 aa, Artificial
  Synthetic peptide
TTGVSTPAPGV

SEQ ID NO: 254 - protein, 15 aa, Artificial
  Synthetic peptide
VRPCLPVPLLLCWPL

SEQ ID NO: 255 - protein, 11 aa, Artificial
  Synthetic peptide
TTGVSTPAPGV

SEQ ID NO: 256 - protein, 25 aa, Artificial
  Synthetic peptide
VSMMIINSQTIMVVNYSSSFITLML

SEQ ID NO: 257 - protein, 15 aa, Artificial
  Synthetic peptide
MCCNLSFGILIPLQK

SEQ ID NO: 258 - protein, 42 aa, Artificial
  Synthetic peptide
VSFSFSLFYKKVIKFACDKRFVGRHDERKVVKLSLPLYLIYE

SEQ ID NO: 259 - protein, 13 aa, Artificial
  Synthetic peptide
VRSTRPEKVFVFQ

SEQ ID NO: 260 - protein, 18 aa, Artificial
  Synthetic peptide
CYKIEITMPKRRKVKLRD

SEQ ID NO: 261 - protein, 6 aa, Artificial
  Synthetic peptide
VFLNFS

SEQ ID NO: 262 - protein, 8 aa, Artificial
  Synthetic peptide
VSIFYVFI

SEQ ID NO: 263 - protein, 5 aa, Artificial
  Synthetic peptide
GKAGV

SEQ ID NO: 264 - protein, 31 aa, Artificial
  Synthetic peptide
PGLERGADKFPVVGGSSLFLALDLTLRPPVG

SEQ ID NO: 265 - protein, 17 aa, Artificial
  Synthetic peptide
VWAATGRRVARVGMLSL

SEQ ID NO: 266 - protein, 12 aa, Artificial
  Synthetic peptide
LWTSLLALTIPS

SEQ ID NO: 267 - protein, 17 aa, Artificial
  Synthetic peptide
VWAATGRRVARVGMLSL

SEQ ID NO: 268 - protein, 37 aa, Artificial
  Synthetic peptide
LASFSHMSDQRSARPQAGQPHGVVLPGRDCEIPLPPV

SEQ ID NO: 269 - protein, 18 aa, Artificial
  Synthetic peptide
NLLKAQCTSTVPRGIPPS

SEQ ID NO: 270 - protein, 5 aa, Artificial
  Synthetic peptide
PHWRH

SEQ ID NO: 271 - protein, 21 aa, Artificial
  Synthetic peptide
KRSRSVAQAGVQWCDHDSPQP

SEQ ID NO: 272 - protein, 24 aa, Artificial
  Synthetic peptide
FWGMSQNSKEWLKCSRTAWTLILM

SEQ ID NO: 273 - protein, 42 aa, Artificial
  Synthetic peptide
HTREGTLGGQKRAFPDGVEGEKGRGRAWGAASRGSAVPLTIR

SEQ ID NO: 274 - protein, 30 aa, Artificial
  Synthetic peptide
GSSGRHHKQLYVQPPLPQVQFPQGHLWRHG

SEQ ID NO: 275 - protein, 124 aa, Artificial
  Synthetic peptide
GCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAP

SEQ ID NO: 276 - protein, 42 aa, Artificial; identical to SEQ ID NO: 273
  Synthetic peptide

SEQ ID NO: 277 - protein, 20 aa, Artificial
  Synthetic peptide
VSVPATTPSPGKHPVSLCLI

SEQ ID NO: 278 - protein, 5 aa, Artificial
  Synthetic peptide
DKRTQ

SEQ ID NO: 279 - protein, 8 aa, Artificial
  Synthetic peptide
GKQGMRAH

SEQ ID NO: 280 - DNA, 853 bp, Artificial
  Synthetic oligonucleotide
gtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataattttttta

SEQ ID NO: 281 - DNA, 162 bp, Artificial
  Synthetic oligonucleotide
ggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagag

SEQ ID NO: 282 - DNA, 130 bp, Artificial
  Synthetic oligonucleotide
caaatttctacgtaagaaggaagaatccagcaagaatatccaacagtcaaatcacttgcccaaatatgaacgggtcaaagaactatgccagcaggccaggtaccagacagcctgtgaacaaccggggcag

SEQ ID NO: 283 - DNA, 217 bp, Artificial
  Synthetic oligonucleotide
aagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaa

SEQ ID NO: 284 - DNA, 256 bp, Artificial
  Synthetic oligonucleotide
agtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaa

SEQ ID NO: 285 - DNA, 176 bp, Artificial
  Synthetic oligonucleotide
ggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacc

SEQ ID NO: 286 - DNA, 143 bp, Artificial
  Synthetic oligonucleotide
tgggatctttctgtgcttgcacgagttctaacaataacacctactggtgtttgcgtacagttaatgagacgcataattttcttttctgtgagtttgctactggctttttggagtattttgatatgaatacagatccttatcag

SEQ ID NO: 287 - DNA, 124 bp, Artificial
  Synthetic oligonucleotide
ctcacaaatacagtgcacacggtagaacgaggcattttgaatcagctacacgtacaactaatggagctcagaagctgtcaaggatataagcagtgcaacccaagacctaagaatcttgatgttg

SEQ ID NO: 288 - DNA, 588 bp, Artificial
  Synthetic oligonucleotide
aggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaag

SEQ ID NO: 289 - DNA, 585 bp, Artificial
  Synthetic oligonucleotide
aacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaa

SEQ ID NO: 290 - DNA, 1188 bp, Artificial
  Synthetic oligonucleotide
ttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctg

SEQ ID NO: 291 - DNA, 45 bp, Artificial
  Synthetic oligonucleotide
gaccctatctgcagatgttctgaatacctctgagaatagagattg

SEQ ID NO: 292 - DNA, 28 bp, Artificial
  Synthetic oligonucleotide
attattcaaccaggatacctaattcaag

SEQ ID NO: 293 - DNA, 15 bp, Artificial
  Synthetic oligonucleotide
aacatccgacccaac

SEQ ID NO: 294 - DNA, 40 bp, Artificial
  Synthetic oligonucleotide
attattcttgtgcttaccgatgatcaagatgtggagctgg

SEQ ID NO: 295 - DNA, 74 bp, Artificial
  Synthetic oligonucleotide
gactacttcacagacttaatcactaacgagagcattaattacttcaaaatgtctaagagaatgtatccccatag

SEQ ID NO: 296 - DNA, 96 bp, Artificial
  Synthetic oligonucleotide
gcccgttatgatggtgatcagccacgctgcgccccacggccccgaggactcagccccacagttttctaaactgtaccccaatgcttcccaacacat

SEQ ID NO: 297 - DNA, 59 bp, Artificial
  Synthetic oligonucleotide
aactcctagttataactatgcaccaaatatggataaacactggattatgcagtacacag

SEQ ID NO: 298 - DNA, 92 bp, Artificial
  Synthetic oligonucleotide
gaccaatgctgcccatccacatggaatttacaaacattctacagcgcaaaaggctccagactttgatgtcagtggatgattctgtggagagg

SEQ ID NO: 299 - DNA, 57 bp, Artificial
  Synthetic oligonucleotide
gtttcgaacaaacaagaaggccaaaatttggcgtgatacattcctagtggaaagagg

SEQ ID NO: 300 - DNA, 97 bp, Artificial
  Synthetic oligonucleotide
gtgttttattcttcccaatgactctatccattgtgagagagaactgtaccaatcggccagagcgtggaaggaccataaggcatacattgacaaagag

SEQ ID NO: 301 - DNA, 95 bp, Artificial
  Synthetic oligonucleotide
attgaagctctgcaagataaaattaagaatttaagagaagtgagaggacatctgaagagaaggaagcctgaggaatgtagctgcagtaaacaaag

SEQ ID NO: 302 - DNA, 66 bp, Artificial
  Synthetic oligonucleotide
ctattacaataaagagaaaggtgtaaaaaagcaagagaaattaaagagccatcttcacccattcaa

SEQ ID NO: 303 - DNA, 34 bp, Artificial
  Synthetic oligonucleotide
gaaataaagatggaggaagctatgacctacacag

SEQ ID NO: 304 - DNA, 53 bp, Artificial
  Synthetic oligonucleotide
cttgacacccctggtaaatctttcaacacacttccactgcctgcgtaatgaag

SEQ ID NO: 305 - DNA, 95 bp, Artificial
  Synthetic oligonucleotide
gtgctgacggccacccaccatcatctaaagaagataaacttggcaaatgacatgcaggttcttcaaggcagaataattgcagaaaatcttcaaag

SEQ ID NO: 306 - DNA, 265 bp, Artificial
  Synthetic oligonucleotide
gtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccag

SEQ ID NO: 307 - DNA, 240 bp, Artificial
  Synthetic oligonucleotide
gtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcag

SEQ ID NO: 308 - DNA, 900 bp, Artificial
  Synthetic oligonucleotide
acccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacag

SEQ ID NO: 309 - DNA, 471 bp, Artificial
  Synthetic oligonucleotide
gcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacag

SEQ ID NO: 310 - DNA, 171 bp, Artificial
  Synthetic oligonucleotide
cagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgg

SEQ ID NO: 311 - DNA, 174 bp, Artificial
  Synthetic oligonucleotide
gacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 312 - DNA, 55 bp, Artificial
  Synthetic oligonucleotide
gtccggacaggccgagatgacgccgagccccctgttgctgctcctgctgccgccg

SEQ ID NO: 313 - DNA, 40 bp, Artificial
  Synthetic oligonucleotide
ctgctgctgggggccttcccgccggccgccgccgcccgag

SEQ ID NO: 314 - DNA, 25 bp, Artificial
  Synthetic oligonucleotide
gtcaactacaccctcgtcgtgctgg

SEQ ID NO: 315 - DNA, 51 bp, Artificial
  Synthetic oligonucleotide
atgacattagcccagggaaggagagcctggggcccgacagctcctctgggg

SEQ ID NO: 316 - DNA, 30 bp, Artificial
  Synthetic oligonucleotide
gtcaagaggaccccgccagccagcagtggg

SEQ ID NO: 317 - DNA, 89 bp, Artificial
  Synthetic oligonucleotide
agcggacccgttccaagcccgtgctcacaggcacgcaccccgtgaacacgacggtggacttcggggggaccacgtccttccagtgcaag

SEQ ID NO: 318 - DNA, 78 bp, Artificial
  Synthetic oligonucleotide
atatgctgcctggacacacagataatgctgccttgacacacacatgcacggatattgcctggacacacacacacacac

SEQ ID NO: 319 - DNA, 90 bp, Artificial
  Synthetic oligonucleotide
gcgtgcacagatatgctgtctggacacgcacacacatgcagatatgctgcctggacacacacttccagacacacgtgcacaggcgcagat

SEQ ID NO: 320 - DNA, 46 bp, Artificial
  Synthetic oligonucleotide
atgctgcctggacacacgcagatatgctgtctagtcacacacacac

SEQ ID NO: 321 - DNA, 27 bp, Artificial
  Synthetic oligonucleotide
gcagacatgctgtccggacacacacac

SEQ ID NO: 322 - DNA, 29 bp, Artificial
  Synthetic oligonucleotide
gcatgcacagatatgctgtccggacacac

SEQ ID NO: 323 - DNA, 8 bp, Artificial
  Synthetic oligonucleotide
acacgcac

SEQ ID NO: 324 - protein, 584 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPGARLPRHATPCWCPDPPPGPGVPPTGWGPTLPSRAVLARSSAEGGQPRGTVSTAPGMGLGCSPGLCVGVPLPTSFPLALADPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 325 - protein, 490 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKTQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 326 - DNA, 19 bp, Artificial
  Synthetic oligonucleotide
atttgggtcgcggttcttg

SEQ ID NO: 327 - DNA, 21 bp, Artificial
  Synthetic oligonucleotide
tgccttgacattctcgatggt

SEQ ID NO: 328 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 329 - DNA, 20 bp, Artificial
  Synthetic oligonucleotide
tgggaacaagagggcatctg

SEQ ID NO: 330 - DNA, 22 bp, Artificial
  Synthetic oligonucleotide
ccaccactgcatcaaattcatg

SEQ ID NO: 331 - DNA, 86 bp, Artificial
  Synthetic oligonucleotide
tgggaacaagagggcatctgctaaagtttcagattccatttctgctcagtatccagtagtggatcatgaatttgatgcagtggtgg

SEQ ID NO: 332 - DNA, 19 bp, Artificial
  Synthetic oligonucleotide
tgagagtgattcgcgtggg

SEQ ID NO: 333 - DNA, 21 bp, Artificial
  Synthetic oligonucleotide
ccagggtacgaggctttcaat

SEQ ID NO: 334 - DNA, 91 bp, Artificial
  Synthetic oligonucleotide
tgagagtgattcgcgtgggtacccgcaagagccagcttgctcgcatacagacggacagtgtggtggcaacattgaaagcctcgtaccctgg

SEQ ID NO: 335 - DNA, 760 bp, Artificial
  Synthetic oligonucleotide
ccaaaatctatgggctgggacagcaaagatgtggcctacgaagagaaaggtctggagaatcagaaggccttcaaatggtggttccaaatccctccagcaaagcccatccatctttagagctcacccgtctccagctacaccccccacccctcccggcccagatcaggcagcggggtcgccctctccaggactctcaaggcagctaaggctggaggcgccggcgagcctggagagggaggagttcactaaattgtgttggatggaaggcgtcgaggaccggaggaattaatccgatgtggggaaggcggacggggctacgaggaaaaaagagggggcaatgtacactcagccttttcatcactcggcggggagatggatggttttccggaccgggcgtcccagcgccccggttagctatagggagacgtcagagcgctctggtccgcgatagaagagccccccagcccccccgcccgggcttccatataaagtaggggccctagtggaggccgcagcagtagcaccagcggctgcggcggcggagctcctccgaggtccgggtcaccagtctctgctcttcccagcctctccggcgcgctccaagggcttcccgtcgggaccatgcgcggcagtgagctcccgctggtcctgctggcgctggtcctctgcctggcgccccgggggcgagcggtcccgctgcctgcgggcggagggaccgtgctgaccaagatgtacccgcgcggcaaccactgggcggtgg

SEQ ID NO: 336 - DNA, 224 bp, Artificial
  Synthetic oligonucleotide
ggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccctgggcaatcagcagccttcgtgggattcagaggatagcagcaacttcaaagat

SEQ ID NO: 337 - DNA, 359 bp, Artificial
  Synthetic oligonucleotide
gttctcaacgtgaaggaaggaacccccagctgaaccagcaatgataatgatggcctctctcaaaagagaaaaacaaaacccctaagagactgcgttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacattgtccaaagggcaggctgtt

SEQ ID NO: 338 - DNA, 19 bp, Artificial
  Synthetic oligonucleotide
gtaggttcaaaaggcaaag

SEQ ID NO: 339 - DNA, 14 bp, Artificial
  Synthetic oligonucleotide
actctctgctccag

SEQ ID NO: 340 - DNA, 178 bp, Artificial
  Synthetic oligonucleotide
ttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcag

SEQ ID NO: 341 - DNA, 780 bp, Artificial
  Synthetic oligonucleotide
ttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaatcaaaagtttctc

SEQ ID NO: 342 - DNA, 93 bp, Artificial
  Synthetic oligonucleotide
gcacggtggctcacgcctgtaatcccagcactttgggaggccgagacgggcggatcacgaggtcaagagatggagaccatcccggctaacacg

SEQ ID NO: 343 - DNA, 6 bp, Artificial
  Synthetic oligonucleotide
attcag

SEQ ID NO: 344 - DNA, 56 bp, Artificial
  Synthetic oligonucleotide
aagaggaaatgaaagcattagaagcagatttcttgaccaatatgcatacatcaaag

SEQ ID NO: 345 - DNA, 115 bp, Artificial
  Synthetic oligonucleotide
attagtaaagcacatgttccctcttggaagatgactctgctaaatgtttgcagtcttgtaaataatttgaacagcccagctgaggaaacaggagaagttcatgaagaggagcttg

SEQ ID NO: 346 - DNA, 34 bp, Artificial
  Synthetic oligonucleotide
ttgcaagaaggaaacttcctactgctttagatgg

SEQ ID NO: 347 - DNA, 26 bp, Artificial
  Synthetic oligonucleotide
ctttagcttggaagcaatgttgacaa

SEQ ID NO: 348 - DNA, 8 bp, Artificial
  Synthetic oligonucleotide
tataccag

SEQ ID NO: 349 - DNA, 42 bp, Artificial
  Synthetic oligonucleotide
ctccacaaaatctgtcacagcagggcttttcaacactgggag

SEQ ID NO: 350 - DNA, 245 bp, Artificial
  Synthetic oligonucleotide
aagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcag

SEQ ID NO: 351 - DNA, 161 bp, Artificial
  Synthetic oligonucleotide
cttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgt

SEQ ID NO: 352 - DNA, 121 bp, Artificial
  Synthetic oligonucleotide
ccatggtacaaggaatagtcgcgcaagcatcccgctggtgcctcccgggacgaaggacttcccgagcggtgtggggaccgggctctgacagccctgcggagaccctgagtccgggaggcac

SEQ ID NO: 353 - DNA, 631 bp, Artificial
  Synthetic oligonucleotide
cgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctccccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctgaataaaa

SEQ ID NO: 354 - DNA, 150 bp, Artificial
  Synthetic oligonucleotide
gtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccag

SEQ ID NO: 355 - DNA, 233 bp, Artificial
  Synthetic oligonucleotide
gtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcag

SEQ ID NO: 356 - DNA, 76 bp, Artificial
  Synthetic oligonucleotide
cttctaagccacaagcacacggggctccagcccccccgagtggaagtgctccccactttctttaggatttaggcgc

SEQ ID NO: 357 - DNA, 119 bp, Artificial
  Synthetic oligonucleotide
ggtctgcgcttcgcagccgggatgaagctggtttccgtcgccctgatgtacctgggttcgctcgccttcctaggcgctgacaccgctcggttggatgtcgcgtcggagtttcgaaagaa

SEQ ID NO: 358 - DNA, 59 bp, Artificial
  Synthetic oligonucleotide
gtggaataagtgggctctgagtcgtgggaagagggaactgcggatgtccagcagctacc

SEQ ID NO: 359 - DNA, 40 bp, Artificial
  Synthetic oligonucleotide
ccaccgggctcgctgacgtgaaggccgggcctgcccagac

SEQ ID NO: 360 - DNA, 51 bp, Artificial
  Synthetic oligonucleotide
ccttattcggccccaggacatgaagggtgcctctcgaagccccgaagacag

SEQ ID NO: 361 - DNA, 84 bp, Artificial
  Synthetic oligonucleotide
cagtccggatgccgcccgcatccgagtcaagcgctaccgccagagcatgaacaacttccagggcctccggagctttggctgccg

SEQ ID NO: 362 - DNA, 573 bp, Artificial
  Synthetic oligonucleotide
ttatgctcccgcggaggccaagcggactccctgacaggacagaatctgaacgtgagagtgaaggtcttgcctgtccagaaactcttgtagccagcacaggtttaaacaagaagccaaattgttctggagagattgctgggggctttctttgtgcctcaagcttcttcagtgccctgagcacaggaaacactcaagcagagaagcagagccaaacccaggatacgggaggtcgaggctcttccgtagacctgcagcattggggtgggatgatgttcattctgtgtgtgttctggaccaagcccctctccagggacctatgggcagccccctttaagcaagatgcccggtggagtgggcatccaccatcacttaccctgggcttgggtgaatagattttccgtgccttaaatgggcagggagggggtaaacatggacggtccattggtacaaataaaagcctttggtgggttttgatcaattgcaaggatcgaaggagacctgtggacctgaggtcaactggcagcagagaagagtctgggttcgtgaaggcgccgccgcggtgccgcgccacgt

SEQ ID NO: 363 - DNA, 387 bp, Artificial
  Synthetic oligonucleotide
gtaagccttccctcttgcttccccactccctgctgggctgagacgctcccaggagatcccgcccctgccacgcatcccagtgcatccctgcttggggtgccagtagcgggaagggcagaagttctgcctgacctggtctgtcatcacaacaagcctgtatcaaatttgaggcacccctcccacgccgcccaagtctcgcgcattctcctcccgagttgtaccagctatacttaagggcagtttaaaaataaaacaaacaaacaaaaacaacaaaactaaaaaaacgaagaactgaacggcggtttaaaaaaaaatagatacacgattattgttaaagatgctagcactggagctgcgcagagcgttggaagtggtgtttggtggagg

SEQ ID NO: 364 - DNA, 249 bp, Artificial
  Synthetic oligonucleotide
atttgcataaaaaaggccaagaaaactctggctgtgccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctcc

SEQ ID NO: 365 - DNA, 10 bp, Artificial
  Synthetic oligonucleotide
gtgctggagc

SEQ ID NO: 366 - DNA, 35 bp, Artificial
  Synthetic oligonucleotide
aggccggcgcttggatcccgctggtcatgaagcag

SEQ ID NO: 367 - DNA, 21 bp, Artificial
  Synthetic oligonucleotide
tgccacccggacaccaagaag

SEQ ID NO: 368 - DNA, 92 bp, Artificial
  Synthetic oligonucleotide
ttcctgtgctcgctcttcgcccccgtctgcctcgatgacctagacgagaccatccagccatgccactcgctctgcgtgcaggtgaaggaccg

SEQ ID NO: 369 - protein, 25 aa, Artificial
  Synthetic peptide
GEKRHHKQLRDQEVDPLEMRRHSAG

SEQ ID NO: 370 - DNA, 60 bp, Artificial
  Synthetic oligonucleotide
ctgcgccccggtcatgtccgccttcggcttcccctggcccgacatgcttgagtgcgaccg

SEQ ID NO: 371 - DNA, 71 bp, Artificial
  Synthetic oligonucleotide
tttcccccaggacaacgacctttgcatccccctcgctagcagcgaccacctcctgccagccaccgaggaag

SEQ ID NO: 372 - DNA, 70 bp, Artificial
  Synthetic oligonucleotide
gctccctctgccccctcggggtcgcgcgcccacgatgctgcagggccctggctcgctgctgctgctcttc

SEQ ID NO: 373 - DNA, 11 bp, Artificial
  Synthetic oligonucleotide
ctcgcctcgca

SEQ ID NO: 374 - DNA, 24 bp, Artificial
  Synthetic oligonucleotide
ctgctgcctgggctcggcgcgcgg

SEQ ID NO: 375 - DNA, 7 bp, Artificial
  Synthetic oligonucleotide
gctcttc

SEQ ID NO: 376 - DNA, 80 bp, Artificial
  Synthetic oligonucleotide
ctctttggccagcccgacttctcctacaagcgcagcaattgcaagcccatcccggccaacctgcagctgtgccacggcat

SEQ ID NO: 377 - DNA, 55 bp, Artificial
  Synthetic oligonucleotide
cgaataccagaacatgcggctgcccaacctgctgggccacgagaccatgaaggag

SEQ ID NO: 378 - DNA, 213 bp, Artificial
  Synthetic oligonucleotide
gactgggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaag

SEQ ID NO: 379 - DNA, 432 bp, Artificial
  Synthetic oligonucleotide
gtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcag

SEQ ID NO: 380 - DNA, 159 bp, Artificial
  Synthetic oligonucleotide
gtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcag

SEQ ID NO: 381 - DNA, 139 bp, Artificial
  Synthetic oligonucleotide
ggttatgtattaagctctattgaaggccgagtggcagttgagtatttggacccaagccctgaggtacagaagaagaagtatgccttcaaatgtcacagactaaaagaaaataatattgagcagatttacccagtcaatg

SEQ ID NO: 382 - DNA, 196 bp, Artificial
  Synthetic oligonucleotide
atatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaa

SEQ ID NO: 383 - DNA, 353 bp, Artificial
  Synthetic oligonucleotide
gtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaaga

SEQ ID NO: 384 - DNA, 590 bp, Artificial
  Synthetic oligonucleotide
tattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtag

SEQ ID NO: 385 - DNA, 1228 bp, Artificial
  Synthetic oligonucleotide
gtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtcttttttttttttaagtatttcagtgaaaacttggtgtaagtctgaacccatcttttgaaatgtattttcttcattgcag

SEQ ID NO: 386 - DNA, 326 bp, Artificial
  Synthetic oligonucleotide
gtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaatgga

SEQ ID NO: 387 - DNA, 70 bp, Artificial
  Synthetic oligonucleotide
gatccaacgcatgcctggagtggaggactagatcatcaattgaaaatgcatgatttgaacactgatcaag

SEQ ID NO: 388 - DNA, 39 bp, Artificial
  Synthetic oligonucleotide
aaaatcttgttgggacccatgatgcccctatcagatgtg

SEQ ID NO: 389 - DNA, 79 bp, Artificial
  Synthetic oligonucleotide
ttgaatactgtccagaagtgaatgtgatggtcactggaagttgggatcagacagttaaactgtgggatcccagaactcc

SEQ ID NO: 390 - DNA, 34 bp, Artificial
  Synthetic oligonucleotide
ttgtaatgctgggaccttctctcagcctgaaaag

SEQ ID NO: 391 - DNA, 33 bp, Artificial
  Synthetic oligonucleotide
atgaccggttctaacgagttcaagctgaaccag

SEQ ID NO: 392 - DNA, 39 bp, Artificial
  Synthetic oligonucleotide
ccatttcttttcacaatatccacaatacatttgccacag

SEQ ID NO: 393 - DNA, 21 bp, Artificial
  Synthetic oligonucleotide
gtggttctgatggctttgtaa

SEQ ID NO: 394 - DNA, 48 bp, Artificial
  Synthetic oligonucleotide
atttgaactgccaaaaatctttcctctccacagaggttgtttctttaa

SEQ ID NO: 395 - DNA, 38 bp, Artificial
  Synthetic oligonucleotide
ccacccgaggatggcatctcctccgtgaagttcagccc

SEQ ID NO: 396 - DNA, 111 bp, Artificial
  Synthetic oligonucleotide
caacacctcccagttcctgcttgtctcctcctgggacacgtccgtgcgtctctacgatgtgccggccaactccatgcggctcaagtaccagcacaccggcgccgtcctgga

SEQ ID NO: 397 - DNA, 13 bp, Artificial
  Synthetic oligonucleotide
ctgcgccttctac

SEQ ID NO: 398 - DNA, 257 bp, Artificial
  Synthetic oligonucleotide
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcg

SEQ ID NO: 399 - DNA, 133 bp, Artificial
  Synthetic oligonucleotide
ctggtcctgccgctgctgtgttgagagagctgcgttgcgtttgtttacagaccacgcagggagttcatcccaaaatgatcagtaatctgcaagtgttcgccataggcccacagtgctccaaggtggaagtggt

SEQ ID NO: 400 - DNA, 1786 bp, Artificial
  Synthetic oligonucleotide
tggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtat

SEQ ID NO: 401 - DNA, 153 bp, Artificial
  Synthetic oligonucleotide
atataatatatattatatatttagcattgctgagctttttagatgcctattgtgtatcttttaaaggttttgaccattttgttatgagtaattacatatatattacattcactatattaaaattgtacttttttactatgtgtctcattggtt

SEQ ID NO: 402 - DNA, 110 bp, Artificial
  Synthetic oligonucleotide
gtaagttctgtgctgctgtgtccgctgtgaccttggcaagagagaaatcccgcagcctgggtcttcaaccttggtatctcatgagtgtatcttctttttctttccttcag

SEQ ID NO: 403 - DNA, 84 bp, Artificial
  Synthetic oligonucleotide
agcctccctgaagaacgggaaggaaatttgtcttgatccagaagccccttttctaaagaaagtcatccagaaaattttggacgg

SEQ ID NO: 404 - DNA, 23 bp, Artificial
  Synthetic oligonucleotide
gtatttatatattatatatttat

SEQ ID NO: 405 - DNA, 139 bp, Artificial
  Synthetic oligonucleotide
gtgcgtctccatggcgacccgccggtgctataagtagggagcggcgtgccgtggggctttgtcagtccctcctgtagccgccgccgccgccgcccgccgcccctctgccagcagctccggcgccacctcgggccggcgt

SEQ ID NO: 406 - DNA, 135 bp, Artificial
  Synthetic oligonucleotide
gttggttttgcggattgccactgatgattccaaagcagtctgtcgtctcagtgtgaaattcggtgccacgctcagaaccagcaggctccttttggaacgggcgaaagagctaaatatcgatgttgttggtgtcag

SEQ ID NO: 407 - DNA, 163 bp, Artificial
  Synthetic oligonucleotide
atcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatg

SEQ ID NO: 408 - DNA, 215 bp, Artificial
  Synthetic oligonucleotide
agacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtg

SEQ ID NO: 409 - DNA, 173 bp, Artificial
  Synthetic oligonucleotide
gatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagtt

SEQ ID NO: 410 - DNA, 1096 bp, Artificial
  Synthetic oligonucleotide
ttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtccctaccatgttgtgtatcttcaccatcttgtctgaccatgaccactggccttgtgtgttcttttactcaacgtgtacccccgctctcccccaaagtgtggcaggctctcatgctccttaacccccattgtggcaatgtcttacgggtaacgctggagctgcaggaggagggaaggacacgtcagagccaccaggcagtgggagcatcttggagtccccaccagcctcatgagggggacaggaagagagcaaatgtgtagggaggaaggctgtggctcctcccggggtgggaaggtcaagccgatgctgtcacccatttaccaaagctgaagagagtgacttcctttctcaaaagcatcaccttcccctgaaccctgagtccagagaagccaggagccctcatgtggctgccgagttagctcagggcttggcttatcaccaactctggtctccctgggccagggttgccaaaacatgaaagattttttcaggagccagaggttggttctgactggaggggga

SEQ ID NO: 411 - DNA, 117 bp, Artificial
  Synthetic oligonucleotide
gacgtcggcccgccggcgccccaccagctccgcgcgggcccgggttggccaccgccgggcccccgcccctcccccggcggtgtcccggccggaaccgatcgtggctggtttgagctg

SEQ ID NO: 412 - DNA, 110 bp, Artificial
  Synthetic oligonucleotide
attgtcactgctgttccaagggcacacgcagagggatttggaattcctggagagttgcctttgtgagaagctggaaatatttctttcaattccatctcttagttttccat

SEQ ID NO: 413 - DNA, 92 bp, Artificial
  Synthetic oligonucleotide
aggaacatcaagaaatcatgaacaactttggtaatgaagagtttgactgccacttcctcgatgaaggttttactgccaaggacattctggac

SEQ ID NO: 414 - DNA, 27 bp, Artificial
  Synthetic oligonucleotide
cagaaaattaatgaagtttcttcttct

SEQ ID NO: 415 - DNA, 72 bp, Artificial
  Synthetic oligonucleotide
ctccggcgggcgggagccaggcgctgacgggcgcggcgggggcggccgagcgctcctgcggctgcgactcag

SEQ ID NO: 416 - DNA, 82 bp, Artificial
  Synthetic oligonucleotide
cttccatgtaggaagcggctgtaccgatcctgagaccttcgtgcaggcaatctctgatgcccgctgtgtttttgacatgggg

SEQ ID NO: 417 - DNA, 56 bp, Artificial
  Synthetic oligonucleotide
gctccggcgtctgcgcttccccatggggctggcctgcggcgcctgggcgctctgag

SEQ ID NO: 418 - DNA, 84 bp, Artificial
  Synthetic oligonucleotide
gctgaggttggtttcagcatgtatctgcttgatattggcggtggctttcctggatctgaggatgtgaaacttaaatttgaagag

SEQ ID NO: 419 - DNA, 113 bp, Artificial
  Synthetic oligonucleotide
acgaagatgagtcgagtgagcagacctttatgtattatgtgaatgatggcgtctatggatcatttaattgcatactctatgaccacgcacatgtaaagccccttctgcaaaag

SEQ ID NO: 420 - DNA, 55 bp, Artificial
  Synthetic oligonucleotide
gcaactcatgcagcaattccagaaccccgacttcccacccgaagtagaggaacag

SEQ ID NO: 421 - DNA, 94 bp, Artificial
  Synthetic oligonucleotide
ttgaaatgtctttgtaagagtagggtcgccatgatgcagccatatggaagactaggatatgggtcacacttatctgtgttcctatggaaactat

SEQ ID NO: 422 - DNA, 271 bp, Artificial
  Synthetic oligonucleotide
gcggccgcagagcactttgcccggagcccagcgtcctcccctgagttcgctgagtctcccgggaccagcaaaggctgcgcgccccgcatcggcccggaggcggggagccctgggaggcctggccgagctgcccgcagggaaatggcggagaaagcgcttctctgcccgagttcagccgggctggggacttggccctgggtcctgaactcggcatggccagttctgcctctggctgtggaccagggtgtggactggagaccgcgggggccag

SEQ ID NO: 423 - DNA, 172 bp, Artificial
  Synthetic oligonucleotide
gggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccg

SEQ ID NO: 424 - DNA, 77 bp, Artificial
  Synthetic oligonucleotide
gagaacttcaacaatgtcccggacctggagctcaaccccatccgatccaaaattgttcgtgccttcttcgacaacag

SEQ ID NO: 425 - DNA, 115 bp, Artificial
  Synthetic oligonucleotide
gaacctgcgcaagggacccagtggcctggctgatgagatcaatttcgaggacttcctgaccatcatgtcctacttccggcccatcgacaccaccatggacgaggaacaggtggag

SEQ ID NO: 426 - DNA, 25 bp, Artificial
  Synthetic oligonucleotide
ctgtcccggaaggagaagctgagat

SEQ ID NO: 427 - DNA, 62 bp, Artificial
  Synthetic oligonucleotide
ttctgttccacatgtacgactcggacagcgacggccgcatcactctggaagaatatcgaaat

SEQ ID NO: 428 - DNA, 108 bp, Artificial
  Synthetic oligonucleotide
gtggtcgaggagctgctgtcgggaaaccctcacatcgagaaggagtccgctcgctccatcgccgacggggccatgatggaggcggccagcgtgtgcatggggcagatg

SEQ ID NO: 429 - DNA, 48 bp, Artificial
  Synthetic oligonucleotide
gagcctgatcaggtgtacgaggggatcaccttcgaggacttcctgaag

SEQ ID NO: 430 - DNA, 9 bp, Artificial
  Synthetic oligonucleotide
atctggcag

SEQ ID NO: 431 - DNA, 108 bp, Artificial
  Synthetic oligonucleotide
gtacatagccaaggctcgtctgcgcaccttgtgtcttgtagggtatggtatgtgggacttcgctgtttttatctccaataaaaaaaaaaaaaaggtttgttaattaat

SEQ ID NO: 432 - DNA, 70 bp, Artificial
  Synthetic oligonucleotide
tctcatcggatcagatcgagcagctccatcggagatttaagcagctgagtggagatcagcctaccattcg

SEQ ID NO: 433 - DNA, 4 bp, Artificial
  Synthetic oligonucleotide
caag

SEQ ID NO: 434 - DNA, 157 bp, Artificial
  Synthetic oligonucleotide
ggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcc

SEQ ID NO: 435 - DNA, 137 bp, Artificial
  Synthetic oligonucleotide
tacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccag

SEQ ID NO: 436 - DNA, 436 bp, Artificial
  Synthetic oligonucleotide
tctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 437 - DNA, 669 bp, Artificial
  Synthetic oligonucleotide
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcct

SEQ ID NO: 438 - DNA, 33 bp, Artificial
  Synthetic oligonucleotide
ggtgactccgggggccctctggtctgtaaccag

SEQ ID NO: 439 - DNA, 75 bp, Artificial
  Synthetic oligonucleotide
aggaacctggggcccgctcctcccccctccaggccatgaggattctgcagttaatcctgcttgctctggcaacag

SEQ ID NO: 440 - DNA, 616 bp, Artificial
  Synthetic oligonucleotide
ccttgctgttcatggcccagcaggggccctatgggggtcaggcctgcaggcactcacacttggcacctgctccaaaaccctttcaggtctttgaggatctgagccctgggcctgggtctcccgccggctcggaaaagctggcctgccgggccagacgagagaaccacacgattcagaaaagcagtgcccttcagcagcctctccaccgtctgggctccccaaaggcagagcgggacgctggaaatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcggatttaaaagaggccagggcgggcggagggaggctgtggagagagcgcggagacaagcgcagagcgcagcgcacggccacagacagccctgggcatccaccgacggcgcagccggagccag

SEQ ID NO: 441 - DNA, 1062 bp, Artificial
  Synthetic oligonucleotide
gtacgccccgcctctactcaccttccttcccaccagacccagctgtggctctcaggatgggaagggacccccccaccaggtcatctagccccatctaatatgtgaacacccaccacaacatccacagcaaacagatactcagacaatgcttacatacccccagggacaaggaactcaccacttaccaaagctagctatccatctcttgtccatttgcaagcatggcaggtttgtcattttgtaaactaaagtctgtctcactctaatatttgcattataatcttaattcctctttttatttcagttacgtaagttgttaaatggcagagtgagcactggcatggctgccaggggagctctgaggacttcagtggggtgaaatgtgaccacttaggtgactgtgtatgttggctataaaactgcgctataaaaccatgaggtgctgaggatgatccttgccagaaacatgttttcttctccaaggtgccccactccctctgctgcccagaaacctgataaactccttccttcgcaggtgctggaaggcaccacaggtttggctctttaaaatcagagccactgttaaccaaggcgggcagcagtgttaagaccaccagcaccctgaaccagccctgtacttactgggcactgtttccttaaaatcagaaggtggcttcccatctctggtttcctggggtcttatgtctgtcctcggagggagaatccagttcctagctcccctgtaccatgcgaaggtagcctgtcctgtctcactcctcagatacgcagagtctgtttacacatttgcctgcatagcatgatcaggaagcacacacacacacacacacacacacacacacgcatgcatgcacacaccatgcaggtgacttccccaggaactagtgccagcacccctgctgcagagggggatatcaaggctaaatggaagagaggggtgacttgcctgggagcacagggcaaagccaggacagcaaaccaggcctcctggtgctaccccaccagctgccctcacagggtggaaggtacagccatagtgggtgc

SEQ ID NO: 442 - DNA, 261 bp, Artificial
  Synthetic oligonucleotide
ctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccac

SEQ ID NO: 443 - DNA, 1361 bp, Artificial
  Synthetic oligonucleotide
gccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgcttttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttctggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacagtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccag

SEQ ID NO: 444 - DNA, 569 bp, Artificial
  Synthetic oligonucleotide
atgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaac

SEQ ID NO: 445 - DNA, 163 bp, Artificial
  Synthetic oligonucleotide
caatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttat

SEQ ID NO: 446 - DNA, 81 bp, Artificial
  Synthetic oligonucleotide
cagagccggaaggcgcgccccgggcagagaaagccgagcagagctgggtggcgtctccgggccgccgctccgacgggccag

SEQ ID NO: 447 - DNA, 56 bp, Artificial
  Synthetic oligonucleotide
ctgcagagcaccaagcgcttcatcaagtggtacaacgcctggaacgagaagcgcag

SEQ ID NO: 448 - DNA, 17 bp, Artificial
  Synthetic oligonucleotide
actctgtcaccctccag

SEQ ID NO: 449 - DNA, 81 bp, Artificial
  Synthetic oligonucleotide
ggtctacgaagaatagggtgaaaaacctcagaagggaaaactccaaaccagttgggagacttgtgcaaaggactttgcaga

SEQ ID NO: 450 - DNA, 20 bp, Artificial
  Synthetic oligonucleotide
ttaaaaaaaaaaaaaaaaaa

SEQ ID NO: 451 - DNA, 108 bp, Artificial
  Synthetic oligonucleotide
aagcctttctttctcacaggcataagacacaaattatatattgttatgaagcactttttaccaacggtcagtttttacattttatagctgcgtgcgaaaggcttccag

SEQ ID NO: 452 - DNA, 40 bp, Artificial
  Synthetic oligonucleotide
cgccctccccatgtccctgctcccacgccgcgcccctccg

SEQ ID NO: 453 - DNA, 23 bp, Artificial
  Synthetic oligonucleotide
cttaggagaaaacttaaaaatat

SEQ ID NO: 454 - DNA, 53 bp, Artificial
  Synthetic oligonucleotide
atgaatacatgcgcaatacacagctacagacacacattctgttgacaagggaa

SEQ ID NO: 455 - DNA, 54 bp, Artificial
  Synthetic oligonucleotide
aaccttcaaagcatgtttctttccctcaccacaacagaacatgcagtactaaag

SEQ ID NO: 456 - DNA, 103 bp, Artificial
  Synthetic oligonucleotide
atgctatgtacatgtcagaaaccattagcattgcatgcaggtttcatattctttctaagatggaaagtaataaaatatatttgaaatgtaccaaaattctaga

SEQ ID NO: 457 - DNA, 36 bp, Artificial
  Synthetic oligonucleotide
gtcagcatgaggctcctggcggccgcgctgctcctg

SEQ ID NO: 458 - DNA, 34 bp, Artificial
  Synthetic oligonucleotide
ctgctgctggcgctgtacaccgcgcgtgtggacg

SEQ ID NO: 459 - DNA, 106 bp, Artificial
  Synthetic oligonucleotide
ggtccaaatgcaagtgctcccggaagggacccaagatccgctacagcgacgtgaagaagctggaaatgaagccaaagtacccgcactgcgaggagaagatggttat

SEQ ID NO: 460 - DNA, 58 bp, Artificial
  Synthetic oligonucleotide
catcaccaccaagagcgtgtccaggtaccgaggtcaggagcactgcctgcaccccaag

SEQ ID NO: 461 - DNA, 669 bp, Artificial
  Synthetic oligonucleotide
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacg

SEQ ID NO: 462 - DNA, 187 bp, Artificial
  Synthetic oligonucleotide
tgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaag

SEQ ID NO: 463 - DNA, 172 bp, Artificial
  Synthetic oligonucleotide
tttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaag

SEQ ID NO: 464 - DNA, 275 bp, Artificial
  Synthetic oligonucleotide
gctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccaca

SEQ ID NO: 465 - DNA, 1685 bp, Artificial
  Synthetic oligonucleotide
gatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagcacatgcctcctgcttcagctcttttttccaaaaagagaaacagaagcaggttccccctccttttatagtgcctgcgtggacacgcggacctccatgcctttcatgctgtggctatgtcagcaaactacgatattgggatgatcctaacgggcaagccagctgcggctcctaccggccgtggccattgaaggccaccatgttgctttgaaacatctcaaagaataacatagtgccagccagcaagggtttcaccatatgcatgacccagacaggaactatcaaaagaagggatcacgggaaggtgcatgatgctaatgtggaatccagaggagctctttcctgatctcttcagcttccgctgccactccagaatcatcagagctgatattaaataagttaaaatgttagtccaccgtctcctcctgcaatcctaaccatcttttgagactgttagaatactttgacgggttgtctttctgtgcaactaatttaaacctcaagtttagtgtaggagatgggtttgtcttctcacctcttcagatctttatcaagggggaataaaagccaacccagaaacctaaactttaaaatttaattatttgaaataataaaacagaagaagggatcaacatttgtcggaattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcag

SEQ ID NO: 466 - DNA, 877 bp, Artificial
  Synthetic oligonucleotide
ccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccatatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctc

SEQ ID NO: 467 - DNA, 252 bp, Artificial
  Synthetic oligonucleotide
gatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaag

SEQ ID NO: 468 - DNA, 349 bp, Artificial
  Synthetic oligonucleotide
gaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 469 - DNA, 233 bp, Artificial
  Synthetic oligonucleotide
cacctcataatcatgtgaaaaagacactcaaaaactaccatttgaatggatggatgaaaataacctccgtatattctacgaagatgtttaataataaataggtttcgttataagagaatgtgtgtcacttcgtctcttccctcacccccgagacttagtgacagttatttttgacttttccaactatactatttgcctagaaaatgtgtctattaaatagcgtattgagaaat

SEQ ID NO: 470 - DNA, 51 bp, Artificial
  Synthetic oligonucleotide
atgatgccgcagctccagcgttggagactcagcctcaaggagatgaagaag

SEQ ID NO: 471 - DNA, 75 bp, Artificial
  Synthetic oligonucleotide
atattgcatcacgttaccctaccctttggactgaacaggttaaaagtcggcagaacaaaaccaataagaattcag

SEQ ID NO: 472 - DNA, 83 bp, Artificial
  Synthetic oligonucleotide
gtacgagcagccgaaatgtgacaacacggccagggcccacccagccaaagcccgggacctgtacaagggccgccagctacaag

SEQ ID NO: 473 - DNA, 103 bp, Artificial
  Synthetic oligonucleotide
gttgtccgggtgccaaaaagcatgagtttctgaccagcgttctggacgcgctgtccacggacatggtccacgccgcctccgacccctcctcctcgtcaggcag

SEQ ID NO: 474 - DNA, 95 bp, Artificial
  Synthetic oligonucleotide
gaagtaagagaaacctgtgatggccagagcccagatgttcttaggaggcaagccaggagaagccgggtctgacttttcagctcagagacagcact

SEQ ID NO: 475 - DNA, 38 bp, Artificial
  Synthetic oligonucleotide
cccccagaggtcatgctgaaagtacgtctaatagacag

SEQ ID NO: 476 - DNA, 75 bp, Artificial
  Synthetic oligonucleotide
ctgatcctcctacctggtccaccccagggctaccggaaggtaaaatcttcacctgaaccaattatgagcagtctc

SEQ ID NO: 477 - DNA, 19 bp, Artificial
  Synthetic oligonucleotide
cttactgaaggtacagccg

SEQ ID NO: 478 - DNA, 65 bp, Artificial
  Synthetic oligonucleotide
ctactgtggttgagaggaaaggtgtctttttattgcttctagagacgttgaaagtgtgacctgag

SEQ ID NO: 479 - DNA, 107 bp, Artificial
  Synthetic oligonucleotide
acgtgtccaggtgtgtggccgaaaggaagtatacccaggagcaagcccggaaggagtttcagcaagtgttcattcctgagtgcaatgacgacggcacctacagtcag

SEQ ID NO: 480 - DNA, 100 bp, Artificial
  Synthetic oligonucleotide
gtccagtgtcacagctacacgggatactgctggtgcgtcacgcccaacgggaggcccatcagcggcactgccgtggcccacaagacgccccggtgcccgg

SEQ ID NO: 481 - DNA, 48 bp, Artificial
  Synthetic oligonucleotide
gttccgtaaatgaaaagttaccccaacgcgaaggcacaggaaaaacag

SEQ ID NO: 482 - DNA, 170 bp, Artificial
  Synthetic oligonucleotide
gctgggagtagagggcagagctcccaccccgccccgcccccagggggcgccccgggcccggcgcgttaggaggcagagggggcgtcaggccgcgggagaggaggccatgggcgcgcgcggggcgctgctgctggcgctgctgctggctcgggctggactcaggaagccgg

SEQ ID NO: 483 - DNA, 120 bp, Artificial
  Synthetic oligonucleotide
gcacacacgcgaggggaccctgggtgggcaaaaacgtgctttcccggacggggttgaaggggagaaagggagaggtcgggcttggggggctgcctcccgcggctcagcagttcctctgac

SEQ ID NO: 484 - DNA, 211 bp, Artificial
  Synthetic oligonucleotide
gcctactacacccgttacttcgtatcgaatatctatctgagccctcgctacctggggaattcaccctatgacattgccttggtgaagctgtctgcacctgtcacctacactaaacacatccagcccatctgtctccaggcctccacatttgagtttgagaaccggacagactgctgggtgactggctgggggtacatcaaagaggatgagg

SEQ ID NO: 485 - DNA, 297 bp, Artificial
  Synthetic oligonucleotide
tgctcaccaatgccccaggcatcaggctcctgggctgcctctccatgcctcccacacccaccctagctctggccgattctcctgcagcactgagcccattcctctccccagaaacttccaagccatgctcaaccgcagctcccacggaaacccctctgggggttcctctggtgggcctgccctggcacctgcgtgtcccccaacacacatgccctgaaagaagtgggcccagcatccggaggagccccggcagccccagactgggcgtgttccctgtatcaggaatcccttccctct

SEQ ID NO: 486 - DNA, 225 bp, Artificial
  Synthetic oligonucleotide
gaaagcatcctgtgtccctgtgccttatttgaccctcatgccaaccccgggaggtggagactgttgccccactctgcagatgcagaaacggaggcttggctgctgccagggggaggaggaggatgtgcacccagtctacccagccccatagcccttcccactctcagcccctcccctgccccactcactctgccccaggctgacctcagccccgctgctccccag

SEQ ID NO: 487 - DNA, 362 bp, Artificial
  Synthetic oligonucleotide
ggtgactcaggtggacccttggcctgtaacaagaatggactgtggtatcagattggagtcgtgagctggggagtgggctgtggtcggcccaatcggcccggtgtctacaccaatatcagccaccactttgagtggatccagaagctgatggcccagagtggcatgtcccagccagacccctcctggccactactctttttccctcttctctgggctctcccactcctggggccggtctgagcctacctgagcccatgcagcctggggccactgccaagtcaggccctggttctcttctgtcttgtttggtaataaacacattccagttgatgccttgcagggcattcttcaaaagcaatggc

SEQ ID NO: 488 - DNA, 515 bp, Artificial
  Synthetic oligonucleotide
ataagaggacacagtgagaagatgggggtctgctcgccaggaaggagccctcaccagcagccgcatcgctcagcaccttgatcctggacttccagcctccagagctgtgagaaacaaacctctatcatctaccagccgcccacggcgtgggatttgtgttacagcagcctgagctgacccagacgccaaggagcaacacacgcaccagggtaggctggagaaaccagaacccgggaatcccgcctccctcaacttgaaacttgggaatagtgtattctcttttcaacacttgcactagtagaaggttaattacatgaaagattaggcaaaatgtatggctatgtgtcctggttttccaataaaagtattgagtttctctggggaaagtgcagataaaatgcttagtggaggctgggcgctgtggcttatgcctgtaatcccagcactttgggaggccgaggcaggcaggcagatcacaaggtcaggagtttgagaccggcctggccaatatgatg

SEQ ID NO: 489 - DNA, 27 bp, Artificial
  Synthetic oligonucleotide
agtcgcaggaggcggcgcccttatcag

SEQ ID NO: 490 - DNA, 8 bp, Artificial
  Synthetic oligonucleotide
catccgag

SEQ ID NO: 491 - DNA, 59 bp, Artificial
  Synthetic oligonucleotide
gaccatgcggccgacgggtcatcacgtcgcgcatcgtgggtggagaggacgccgaactc

SEQ ID NO: 492 - DNA, 42 bp, Artificial
  Synthetic oligonucleotide
gggcgttggccgtggcaggggagcctgcgcctgtgggattcc

SEQ ID NO: 493 - DNA, 65 bp, Artificial
  Synthetic oligonucleotide
cacgtatgcggagtgagcctgctcagccaccgctgggcactcacggcggcgcactgctttgaaac

SEQ ID NO: 494 - DNA, 6 bp, Artificial
  Synthetic oligonucleotide
ctatag

SEQ ID NO: 495 - DNA, 76 bp, Artificial
  Synthetic oligonucleotide
tgaccttagtgatccctccgggtggatggtccagtttggccagctgacttccatgccatccttctggagcctgcag

SEQ ID NO: 496 - DNA, 37 bp, Artificial
  Synthetic oligonucleotide
gttgctgtctctctccttcccactatcgtccgcacag

SEQ ID NO: 497 - DNA, 26 bp, Artificial
  Synthetic oligonucleotide
cactgccatctccccacaccctccag

SEQ ID NO: 498 - DNA, 59 bp, Artificial
  Synthetic oligonucleotide
gaagttcaggtcgccatcataaacaactctatgtgcaaccacctcttcctcaagtacag

SEQ ID NO: 499 - DNA, 28 bp, Artificial
  Synthetic oligonucleotide
tttccgcaaggacatctttggagacatg

SEQ ID NO: 500 - DNA, 42 bp, Artificial
  Synthetic oligonucleotide
gtttgtgctggcaatgcccaaggcgggaaggatgcctgcttc

SEQ ID NO: 501 - DNA, 31 bp, Artificial
  Synthetic oligonucleotide
gtgagtgtccctgccaccactcccagcccag

SEQ ID NO: 502 - DNA, 712 bp, Artificial
  Synthetic oligonucleotide
gcagcgagcgcggctccacattgttgcggatcgccggcacccggcagagcggcggcggctgggacgcgcggcgcctccgacccgttctcctcgcgcccggccgcgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccag

SEQ ID NO: 503 - DNA, 302 bp, Artificial
  Synthetic oligonucleotide
cggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatgg

SEQ ID NO: 504 - DNA, 206 bp, Artificial
  Synthetic oligonucleotide
ccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgc

SEQ ID NO: 505 - DNA, 139 bp, Artificial
  Synthetic oligonucleotide
gctaaatggctctctccccaagggtgtggaggcccagaacagaaccctcttcttcaagggacccatcaactacagcctggcagggacctacatctgtgaggccaccaaccccatcggtacacgctcaggccaggtggag

SEQ ID NO: 506 - DNA, 1474 bp, Artificial
  Synthetic oligonucleotide
gtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagcccacccacctcagtcagagaaccaggaccccaaaggcatgcagagcccccacttccccactgtcttggccagccagggaccccagaagagaggttacaacccttcaggaatagggacaagctgctccctttgtaagaggatgtgagggaggctggctgggcccctgccagcaaacacaaatgaccctgcggcctggctcttctctctcctcccagctgcggcccttgcagctctgctcctggcacagagacaggagctactggctgagtgtaacagctggagggatggagggggaggggaggacgctccactccacgccagacagccccttctgcttgcaaatgagttagatccccatgcttctcctttcttctctccctcactcagtatcctcactcgaaagtctttgatgctggaaggtcatcccagccattctgctgctgctacacaggcccagccctaaacaaaataaccggggttctttggtcccaaaagatccccaggaaagagtaaacctccttaagacttaaggaaaaaagttggctaggcgtggtggctcacacctgtaatcccagcactttgggaggccgaggtgggcagaccacttgagatcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtcccgcaaaaaaaaaaaaaaaaaa

SEQ ID NO: 507 - DNA, 464 bp, Artificial
  Synthetic oligonucleotide
aattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccag

SEQ ID NO: 508 - DNA, 277 bp, Artificial
  Synthetic oligonucleotide
tacgaccctgagcagctggacttggctgagaacatggtttctcagaacgacgggtctttcatttccaagaaggagtggtacgtgtagccccccttccagagcctctgtctgtgaccgctcctaaccagcccctccccgcacgccccctgcccaccccccacctcccactccaggagctgaacagagacttgcccagctgcccaaagccagccccgaactcctggggggccaggggagcccagggcagccacgacttggctttgtgttttatttcctc

SEQ ID NO: 509 - DNA, 37 bp, Artificial
  Synthetic oligonucleotide
gcgtccactcccaggtggtccaggtgaacgactccat

SEQ ID NO: 510 - DNA, 12 bp, Artificial
  Synthetic oligonucleotide
gtatggcttcat

SEQ ID NO: 511 - DNA, 97 bp, Artificial
  Synthetic oligonucleotide
ctggtgcccagcagggaagcccaccagcagtccttggcctgcatcgtcaactaccacatggaccgcttcaaggaaagcctcactctcaacgtgcagt

SEQ ID NO: 512 - DNA, 118 bp, Artificial
  Synthetic oligonucleotide
atgagcctgaggtaaccattgaggggtttgatggcaactggtacctgcagcggatggacgtgaagctcacctgcaaagctgatgctaaccccccagccactgagtaccactggaccac

SEQ ID NO: 513 - DNA, 13 bp, Artificial
  Synthetic oligonucleotide
gtcaatatcacag

SEQ ID NO: 514 - DNA, 107 bp, Artificial
  Synthetic oligonucleotide
ctttctgtcaacttatctatccgggcaaagggaggacaagagctaggatgttctgaggagagacttcacctgggacgtgaaaggagcatgggcttgatgtcagacag

SEQ ID NO: 515 - DNA, 20 bp, Artificial
  Synthetic oligonucleotide
ctgtgaccctggacagggcc

SEQ ID NO: 516 - DNA, 28 bp, Artificial
  Synthetic oligonucleotide
ccccccaccatctgtaaaacggggacag

SEQ ID NO: 517 - DNA, 112 bp, Artificial
  Synthetic oligonucleotide
tatgatgtaccttgaagggctgttgtcagaattctacgtgatgtaagtcaagcacctagcacagatcagtctgtcaataaatggccaatgttccgtgattattaccctgacc

SEQ ID NO: 518 - DNA, 264 bp, Artificial
  Synthetic oligonucleotide
gggtctcccacttgtccagacagcggccgggcttgtcacggggctctgtgcagccttttccactctcccggctgccagcgtcccgccccgtcccctcccagcccccaagggaggaggggagagctgcagagaggaggaggggtcggggaggcccggctttataaaggcggctggaacaaccctgcccgccagaccccgtcgcccggatcccctgagctgcccgccatcccacgtgaccgcgccgccccccagctccaccgctga

SEQ ID NO: 519 - DNA, 156 bp, Artificial
  Synthetic oligonucleotide
ctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaa

SEQ ID NO: 520 - DNA, 141 bp, Artificial
  Synthetic oligonucleotide
ctccccaaccgggcagtggagccccagctgcaggaggaagagcggatggtgtatgtggccttctctgagttcttcttcgactctgccatggagagctacttccgggcgggggccctgcagctgttgctggtgggggacaag

SEQ ID NO: 521 - DNA, 419 bp, Artificial
  Synthetic oligonucleotide
ctatcaattacagtccgtccaccacctccctgtgggctgtcctgagctctgttgggttcctgggatggaatcagtgcatcataaagggcattctttaagcagagaaggggccaggccaccccattcaggaactgctgcgggaataaagtgctaacttgcccccaggctgtctatgggagaccctgggcccagtctgggatgtacagggctctgggaagggggcagtcctggcggcagaacccggcctgcaggggcactttgcttagaagaggactctcctagcgggagaggctgggaggggctgcatcaggccgtggagctggttgctgtggtcatcagtatggctgcttgttcaggaagcgggagaacatggtgaaggcagcgaggggcttgtcggtgggaaccatgtggccggcgcc

SEQ ID NO: 522 - DNA, 232 bp, Artificial
  Synthetic oligonucleotide
gttcgtgagctcctgaccccaccattccctcctccccatataactgctcactcgggggcaattccttcatcccaaaccctttattcttcccagaaccctccccacccctctccaaaaaaacttgcccatacaggggccagatggtgacccatgacccagcctaaaaggcagccagagggaaaggacgggtgggtcctgctcctttgcctccggcccagttatctctcagcag

SEQ ID NO: 523 - DNA, 280 bp, Artificial
  Synthetic oligonucleotide
cttctggttgagggaatccacaaaccactcatcccccatgaaattgcaggccatgtctacatctccattatataataggatctggtatttctaaagcaggatggggtaaaaatgaggggtgtggaacaagcccagtccccagcccttccctagttcaaggcctacccctcaggaaattcaaggggccaagctagataacacgaaccagggaattttcatgttttctaacgacttactgcatgtccagtattctactaaatgttttatctgtgaaagtaga

SEQ ID NO: 524 - DNA, 73 bp, Artificial
  Synthetic oligonucleotide
gcccgctcgccatggccctcttcggggccctcttcctagcgctgctggcaggcgcacatgcagagttcccagg

SEQ ID NO: 525 - DNA, 18 bp, Artificial
  Synthetic oligonucleotide
ctgcaagatccgcgtcac

SEQ ID NO: 526 - DNA, 20 bp, Artificial
  Synthetic oligonucleotide
ctccaaggcgctggagctgg

SEQ ID NO: 527 - DNA, 8 bp, Artificial
  Synthetic oligonucleotide
tgaagcag

SEQ ID NO: 528 - DNA, 6 bp, Artificial
  Synthetic oligonucleotide
gagggg

SEQ ID NO: 529 - DNA, 35 bp, Artificial
  Synthetic oligonucleotide
ctgcgctttctggagcaagagctggagactatcac

SEQ ID NO: 530 - DNA, 51 bp, Artificial
  Synthetic oligonucleotide
cattccggacctgcggggcaaagaaggccacttctactacaacatctctga

SEQ ID NO: 531 - DNA, 92 bp, Artificial
  Synthetic oligonucleotide
gcctggacttgaaaggggagcagacaaatttcctgtcgttgggggaagttccctcttcttggccctggatctgaccctgaggcctcctgtag

SEQ ID NO: 532 - DNA, 16 bp, Artificial
  Synthetic oligonucleotide
ggtgaaggtcacagag

SEQ ID NO: 533 - DNA, 89 bp, Artificial
  Synthetic oligonucleotide
ctgcaactgacatcttccgagctcgatttccagccacagcaggagctgatgcttcaaatcaccaatgcctccttggggctgcgcttccg

SEQ ID NO: 534 - DNA, 24 bp, Artificial
  Synthetic oligonucleotide
gagacagctgctctactggttctt

SEQ ID NO: 535 - DNA, 52 bp, Artificial
  Synthetic oligonucleotide
gaaggtgtatgattttctctccacgttcatcacctcagggatgcgcttcctc

SEQ ID NO: 536 - DNA, 12 bp, Artificial
  Synthetic oligonucleotide
ctcaaccagcag

SEQ ID NO: 537 - DNA, 85 bp, Artificial
  Synthetic oligonucleotide
gtgtgggcagcgacaggtcgcagggtggcaagggtgggcatgctctcactttgagaaggccctgactctggctcccacctcgcag

SEQ ID NO: 538 - DNA, 64 bp, Artificial
  Synthetic oligonucleotide
atctgccctgtcctctaccacgcagggacggtcctgctcaactccctcctggacaccgtgcctg

SEQ ID NO: 539 - DNA, 7 bp, Artificial
  Synthetic oligonucleotide
tgcgcag

SEQ ID NO: 540 - DNA, 85 bp, Artificial
  Synthetic oligonucleotide
ttctgtggacgagcttgttggcattgactattccctcatgaaggatcctgtggcttccaccagcaacctggacatggacttccgg

SEQ ID NO: 541 - DNA, 36 bp, Artificial
  Synthetic oligonucleotide
ggggccttcttccccctgactgagaggaactggagc

SEQ ID NO: 542 - DNA, 45 bp, Artificial
  Synthetic oligonucleotide
gtgccccacgacctggacatgctgctgagggccacctactttggg

SEQ ID NO: 543 - DNA, 15 bp, Artificial
  Synthetic oligonucleotide
agcattgtcctgctg

SEQ ID NO: 544 - DNA, 30 bp, Artificial
  Synthetic oligonucleotide
agcccagcagtgattgactccccattgaag

SEQ ID NO: 545 - DNA, 87 bp, Artificial
  Synthetic oligonucleotide
ctggagctgcgggtcctggccccaccgcgctgcaccatcaagccctctggcaccaccatctctgtcactgctagcgtcaccattgcc

SEQ ID NO: 546 - DNA, 30 bp, Artificial
  Synthetic oligonucleotide
ctggtcccaccagaccagcctgaggtccag

SEQ ID NO: 547 - DNA, 18 bp, Artificial
  Synthetic oligonucleotide
ctgtccagcatgactatg

SEQ ID NO: 548 - DNA, 27 bp, Artificial
  Synthetic oligonucleotide
gacgcccgtctcagcgccaagatggct

SEQ ID NO: 549 - DNA, 41 bp, Artificial
  Synthetic oligonucleotide
ctccgggggaaggccctgcgcacgcagctggacctgcgcag

SEQ ID NO: 550 - DNA, 43 bp, Artificial
  Synthetic oligonucleotide
gttccgaatctattccaaccattctgcactggagtcgctggct

SEQ ID NO: 551 - DNA, 15 bp, Artificial
  Synthetic oligonucleotide
ctgatcccattacag

SEQ ID NO: 552 - DNA, 49 bp, Artificial
  Synthetic oligonucleotide
gcccctctgaagaccatgctgcagattggggtgatgcccatgctcaatg

SEQ ID NO: 553 - DNA, 83 bp, Artificial
  Synthetic oligonucleotide
gtaaggctggggtgtgaggatggaggaagaaaggaggggtgaactgggcgggcccagactgagcggggtgctcccacccacag

SEQ ID NO: 554 - DNA, 41 bp, Artificial
  Synthetic oligonucleotide
agcggacctggcgtggggtgcagatcccactacctgagggc

SEQ ID NO: 555 - DNA, 36 bp, Artificial
  Synthetic oligonucleotide
atcaactttgtgcatgaggtggtgacgaaccatgcg

SEQ ID NO: 556 - DNA, 24 bp, Artificial
  Synthetic oligonucleotide
ggattcctcaccatcggggctgat

SEQ ID NO: 557 - DNA, 36 bp, Artificial
  Synthetic oligonucleotide
ctccactttgccaaagggctgcgagaggtgattgag

SEQ ID NO: 558 - DNA, 23 bp, Artificial
  Synthetic oligonucleotide
aagaaccggcctgctgatgtcag

SEQ ID NO: 559 - DNA, 9 bp, Artificial
  Synthetic oligonucleotide
ggcgtccac

SEQ ID NO: 560 - DNA, 23 bp, Artificial
  Synthetic oligonucleotide
tgcccccacaccgtccacagcag

SEQ ID NO: 561 - DNA, 24 bp, Artificial
  Synthetic oligonucleotide
ctgtctgagccctcaatccccaag

SEQ ID NO: 562 - DNA, 7 bp, Artificial
  Synthetic oligonucleotide
ctggcag

SEQ ID NO: 563 - DNA, 20 bp, Artificial
  Synthetic oligonucleotide
ctgtcattcaggaccccaac

SEQ ID NO: 564 - DNA, 90 bp, Artificial
  Synthetic oligonucleotide
ccctctcagcccctcttttcccacattcatagcctgtagtgccccctctaacccccagtgccacagagaagacgggatttgaagctgtac

SEQ ID NO: 565 - DNA, 22 bp, Artificial
  Synthetic oligonucleotide
ccaatttaattccataatcaat

SEQ ID NO: 566 - DNA, 12 bp, Artificial
  Synthetic oligonucleotide
ctgaggagcaat

SEQ ID NO: 567 - DNA, 13 bp, Artificial
  Synthetic oligonucleotide
gcccagtccctac

SEQ ID NO: 568 - DNA, 105 bp, Artificial
  Synthetic oligonucleotide
cttgatcgtgagaaaggcgatgtgggagaactccttcacgaagccggcaatctgctccccgctgtccccgtacttcactaaccagggccggcgctgcacctccat

SEQ ID NO: 569 - DNA, 108 bp, Artificial
  Synthetic oligonucleotide
ctgccccaccaggaaagacatcagcctacagcagctgcatccttgctcacagctaccagcaagaccttagggctgggaattcctccacacttgccctctgtgggccag

SEQ ID NO: 570 - DNA, 90 bp, Artificial
  Synthetic oligonucleotide
agccaggcagccagctggccactcccaggcatacccgctcccaatcctccacagcagcccctatcccagggccaggaatctctaccttac

SEQ ID NO: 571 - DNA, 774 bp, Artificial
  Synthetic oligonucleotide
cgctcagtccggcagcgcagcaggagggaggcgcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccg

SEQ ID NO: 572 - DNA, 170 bp, Artificial
  Synthetic oligonucleotide
gtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatcta

SEQ ID NO: 573 - DNA, 175 bp, Artificial
  Synthetic oligonucleotide
cggcggcgggtttgcttcctgcgctctgagatgagctgccctcggctccctccggggtggcgcgcccgggggaggggggagttgggggctggatagcttcccagcaccctcagagcccccgcccggctgtgccccgtctgaccaaagttataataaaaacattttcaccccgcag

SEQ ID NO: 574 - DNA, 83 bp, Artificial
  Synthetic oligonucleotide
gcacctactttttcacctaccatgtcctcatgcgcggcggcgacggcaccagtatgtgggcagacctctgcaagaatggccag

SEQ ID NO: 575 - DNA, 102 bp, Artificial
  Synthetic oligonucleotide
ctccgactgagctccccacgtctccctccacccacgtccctcacccgccggggtcccctccgggcggggcagacgatgactcgcccctcgcccacccgctcg

SEQ ID NO: 576 - DNA, 115 bp, Artificial
  Synthetic oligonucleotide
ctgcccggccctccccggctatgacgcccccggcccgtgctcaacaccgcctgggccacagctaggccctcccaccggctcgctgcagagccgggcccagcgcgccctgtccccg

SEQ ID NO: 577 - DNA, 76 bp, Artificial
  Synthetic oligonucleotide
tgccagggaaccggggttgaccgcccccgcccagcccgcgctatatatttgtacaataggactgtttactgcccac

SEQ ID NO: 578 - DNA, 38 bp, Artificial
  Synthetic oligonucleotide
ctccgcctgccagcccaccccagcctggggagaggtcg

SEQ ID NO: 579 - DNA, 1098 bp, Artificial
  Synthetic oligonucleotide
tttttgtttgtgtacttaataaagggtaaatatgtcatgtttgtttggaacagtcatggttaatatctatgttgtcccagtatatctattaatagaactctctttcactctcaacagcgtcctagtccggatgacaaattatatggttatctctcagtaaagggtctttttttaaaatgatttttttttcagggggtagggtaggcaggaagcttaaactgggtaatttagttgtagaagagtgccctgtggcaaataattgattattcatttccagcatccccttttcttctccttgacagttattaaaaaaaaaaaagttaccagcttatgtcattttaaagaacactcgccctgaaaacttctgagaggttggccatttgaaaccctggttttagtgtctgtattattagtgaactaccgtgttcccatgtggctacacaaccacaattatgtactatctggctctttaccaaagtttgcagacctctaatctagagtgcgacatttcccctcattaactcttaggtcccttggctctaaaagggtatattcatcttggccctatacagggaaagggggaatgggattaatgatgtgctttgtaagaagaaccaattttaattttcacaaaggcttgacgtagctgtgagagaaagggtaagaagaagcaggcttcttcttagaagtctgagatggcctaaagtggtgggggaagaagggagagtggggagaaagagaaacaagaaaagctgagagtgaattccccagagaggtagccactgattctgccctactctttgctggaattctggaaaacacctgggcttctaaaagatagggagctcatgcatcatggtagggccacagctcaggctagggccagagatagctcagagtagcgccacggctcagggtaggtccacagtgcagggtagggccatagctcagagtagggccatagctcataaccacagctcagggtaggacctgctgatctatttggggacccccagcagagcctgtctaattgcatatcttgaaaaggattggaaaactgtcataatgacattattccctctcactttccttgtccag

SEQ ID NO: 580 - DNA, 259 bp, Artificial
  Synthetic oligonucleotide
gaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctg

SEQ ID NO: 581 - DNA, 201 bp, Artificial
  Synthetic oligonucleotide
ccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttacagtg

SEQ ID NO: 582 - DNA, 13 bp, Artificial
  Synthetic oligonucleotide
gtttttgcaagtg

SEQ ID NO: 583 - DNA, 11 bp, Artificial
  Synthetic oligonucleotide
ctgcatttccg

SEQ ID NO: 584 - DNA, 128 bp, Artificial
  Synthetic oligonucleotide
attttcaaacaccgcattccccttaaacctcccaggctcccatcactcccagcaaagagccagcccgctactttatggagacaggagagactgtcagacagttcctgctgctgcccaggtgcatctga

SEQ ID NO: 585 - DNA, 177 bp, Artificial
  Synthetic oligonucleotide
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccg

SEQ ID NO: 586 - DNA, 597 bp, Artificial
  Synthetic oligonucleotide
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcag

SEQ ID NO: 587 - DNA, 483 bp, Artificial
  Synthetic oligonucleotide
gcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacag

SEQ ID NO: 588 - DNA, 443 bp, Artificial
  Synthetic oligonucleotide
gctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccag

SEQ ID NO: 589 - DNA, 528 bp, Artificial
  Synthetic oligonucleotide
ctgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacag

SEQ ID NO: 590 - DNA, 1146 bp, Artificial
  Synthetic oligonucleotide
gtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatg

SEQ ID NO: 591 - DNA, 128 bp, Artificial
  Synthetic oligonucleotide
gtggtccgtactgagaagaacagtttgaacaaccgattcttaccctggaatgaaattgagacagaggccatcctgtccattgatgacgatgctcacctccgccatgacgaaatcatgtttgggttccg

SEQ ID NO: 592 - DNA, 145 bp, Artificial
  Synthetic oligonucleotide
ggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaag

SEQ ID NO: 593 - DNA, 412 bp, Artificial
  Synthetic oligonucleotide
gtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 594 - DNA, 245 bp, Artificial
  Synthetic oligonucleotide
cttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcag

SEQ ID NO: 595 - DNA, 617 bp, Artificial
  Synthetic oligonucleotide
ctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttat

SEQ ID NO: 596 - DNA, 238 bp, Artificial
  Synthetic oligonucleotide
ccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctag

SEQ ID NO: 597 - DNA, 128 bp, Artificial
  Synthetic oligonucleotide
tgtagagcaagccagtgtccttcgaggaacccacccggctggccgggaagttttacagcaaggcgcctgccttgggataattccttggtgaaattcaccttccccccgcctctgtctggagccccatc

SEQ ID NO: 598 - DNA, 242 bp, Artificial
  Synthetic oligonucleotide
ctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgac

SEQ ID NO: 599 - DNA, 156 bp, Artificial
  Synthetic oligonucleotide
gtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatac

SEQ ID NO: 600 - DNA, 730 bp, Artificial
  Synthetic oligonucleotide
cctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttggg

SEQ ID NO: 601 - DNA, 188 bp, Artificial
  Synthetic oligonucleotide
ctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 602 - DNA, 49 bp, Artificial
  Synthetic oligonucleotide
ggctgcagtggccgccgctggagaccgcgggacctggcgctgcagcgag

SEQ ID NO: 603 - DNA, 94 bp, Artificial
  Synthetic oligonucleotide
gagagcaagccctggaggttcactctttcaagaagtcgtgtgctgaggtgtaatgctacacaagtcagaggaaggaagggtcctgaaacacatg

SEQ ID NO: 604 - DNA, 24 bp, Artificial
  Synthetic oligonucleotide
cccaagctgtccctgcccatccga

SEQ ID NO: 605 - DNA, 79 bp, Artificial
  Synthetic oligonucleotide
tcctgagctcaggcaacctgcccgcctcggcctcccagagtgctgggattacaggcatgagccacggtgcccagcccag

SEQ ID NO: 606 - DNA, 77 bp, Artificial
  Synthetic oligonucleotide
atgggttctcactttattgttcaagctggtctgaaactcctggcctcgagcaagcctcccaagtgctgggattacag

SEQ ID NO: 607 - DNA, 36 bp, Artificial
  Synthetic oligonucleotide
tattatgcctacctgtattcttatgtgatgccccag

SEQ ID NO: 608 - DNA, 93 bp, Artificial
  Synthetic oligonucleotide
gccatccgggacatggtggatgaatacatcaactgtgaggacattgccatgaacttccttgtctcccacatcactcggaagccccccatcaag

SEQ ID NO: 609 - DNA, 92 bp, Artificial
  Synthetic oligonucleotide
gtgacctcacggtggacattccgatgcccaggatgccctcaggccctgtctcatgatgactcccacttccacgagcggcacaagtgcatcaa

SEQ ID NO: 610 - DNA, 54 bp, Artificial
  Synthetic oligonucleotide
caggaggagtggaaggaaaccgctgcctttatcttgaagtcagccacactgggc

SEQ ID NO: 611 - DNA, 41 bp, Artificial
  Synthetic oligonucleotide
ctgtgttatctgtggtttttggacccctaatgtcagcttgg

SEQ ID NO: 612 - DNA, 84 bp, Artificial
  Synthetic oligonucleotide
gttctcctctgacctgcctgtaccacgtgggtcctcttcaagtactgttttgaagctgggctcttttgtgtagctcccacccac

SEQ ID NO: 613 - DNA, 107 bp, Artificial
  Synthetic oligonucleotide
ctgtagggctagctcggcttaagggaactctccccattggcaaaccggacccggccgccgccaggactgtgtttccaaaggttccccgcccccaaccccagcatcag

SEQ ID NO: 614 - DNA, 86 bp, Artificial
  Synthetic oligonucleotide
ctgtcttaccataacaccgtcccagggctctgcaggccactgtgagcgctggctccctgggcagtgctcctccgtgtggactgtgc

SEQ ID NO: 615 - DNA, 28 bp, Artificial
  Synthetic oligonucleotide
ctcaggccagggctcaccagctggggtc

SEQ ID NO: 616 - DNA, 355 bp, Artificial
  Synthetic oligonucleotide
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcc

SEQ ID NO: 617 - DNA, 148 bp, Artificial
  Synthetic oligonucleotide
cccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggg

SEQ ID NO: 618 - DNA, 125 bp, Artificial
  Synthetic oligonucleotide
acatgaatgaacacagctctagaagtcacagtatcttcctgataaatattaaacaagagaatgtagagactgaaaaaaaactcagtgggaaactttatttggttgatttggctgggagcgaaaag

SEQ ID NO: 619 - DNA, 147 bp, Artificial
  Synthetic oligonucleotide
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcag

SEQ ID NO: 620 - DNA, 125 bp, Artificial
  Synthetic oligonucleotide
gctgattgtccccatgaaggccagccttgaagcttggtcagtctccctaactgtatgattgatccccacttattgcactacatcactgagttcccgtatgccaagttatggccacttacatccac

SEQ ID NO: 621 - DNA, 149 bp, Artificial
  Synthetic oligonucleotide
aaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagag

SEQ ID NO: 622 - protein, 8 aa, Artificial
  Synthetic peptide
RGSLGSAQ

SEQ ID NO: 623 - DNA, 149 bp, Artificial
  Synthetic oligonucleotide
agctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatg

SEQ ID NO: 624 - DNA, 167 bp, Artificial
  Synthetic oligonucleotide
attttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccag

SEQ ID NO: 625 - DNA, 176 bp, Artificial
  Synthetic oligonucleotide
gagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaag

SEQ ID NO: 626 - DNA, 504 bp, Artificial
  Synthetic oligonucleotide
gtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 627 - DNA, 207 bp, Artificial
  Synthetic oligonucleotide
cttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacg

SEQ ID NO: 628 - DNA, 147 bp, Artificial
  Synthetic oligonucleotide
actacattgacaaccacacagagagagctgagccagctacaagagcttagcaaccaccagaagaaaagggcaactgagatcctgaatttgctgttgaaagatctgggggagataggtggaattattggcaccaatgatgtgaaaact

SEQ ID NO: 629 - DNA, 189 bp, Artificial
  Synthetic oligonucleotide
ttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccag

SEQ ID NO: 630 - DNA, 340 bp, Artificial
  Synthetic oligonucleotide
gtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 631 - DNA, 688 bp, Artificial
  Synthetic oligonucleotide
aagcttccctggcttgtgcctttcaaatggactctgggttttccttctggtagtgcatagctgttcctttacaggcgcttaggcgtggctctaggaaaggttttatgagtcctgggctgatgtaaatgttgaccaaacaccctcaaccagatggcgagtttctgtttgcagcagagcccaggctgtcttttcttcataattctctctgtgcccactcctcgagggcaggaactgtccctgtatcagtgaggcattcggacttgggagatgtttttagaacatcagaccagaaatgagggaaggtggaaatggccaaatcaggttccccaagtgactgcatgccatccgaggggccgaggaagcagagttcttctgacatgggctctctgttttaaaatatcagcccttctcccatctcattatttttcccctgaagctcttgcacaagcaaactataaatacatcctcaaagccttatgtttcatgactcttagatgcaccccagaaattagttttcacttgggcacggaggaagctgtgaggctgttctgtgatccctccaaatcctgcagaattactgcctttattgtacagagctaatagggttggaacagaaccacggttttagcctgatgactcagaatttcagactgatgtggaatatattgctttttcctctcaatttcag

SEQ ID NO: 632 - DNA, 136 bp, Artificial
  Synthetic oligonucleotide
gtgagttctctttgtctgaatgggactgagaagaaaatcaaagatggcagggaagaatcattttcagttgaaatatcacttgcttaagtcggggctggttatgcttaaaaattaattactgcacaccagagaatgt

SEQ ID NO: 633 - DNA, 217 bp, Artificial
  Synthetic oligonucleotide
ctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcg

SEQ ID NO: 634 - DNA, 1320 bp, Artificial
  Synthetic oligonucleotide
atatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgtt

SEQ ID NO: 635 - DNA, 933 bp, Artificial
  Synthetic oligonucleotide
gtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccacttt

SEQ ID NO: 636 - DNA, 1247 bp, Artificial
  Synthetic oligonucleotide
tttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 637 - DNA, 18 bp, Artificial
  Synthetic oligonucleotide
ccccacccatccccgtgc

SEQ ID NO: 638 - DNA, 91 bp, Artificial
  Synthetic oligonucleotide
caagggaagccatatgtcttcgacagagtgctacctcccaacacgacccaagagcaggtttacaatgcatgtgcgaagcaaattgtcaaag

SEQ ID NO: 639 - DNA, 74 bp, Artificial
  Synthetic oligonucleotide
atgtccttgaaggttataacgggacgatttttgcgtatgggcagacttcatcaggaaaaacccacaccatggag

SEQ ID NO: 640 - DNA, 105 bp, Artificial
  Synthetic oligonucleotide
gggaagctgcatgacccccagctcatggggatcatcccacgaattgcccatgatatctttgaccatatctactccatggatgagaacctggagtttcacataaag

SEQ ID NO: 641 - DNA, 49 bp, Artificial
  Synthetic oligonucleotide
gtttcctattttgagatctacttggacaaaataagggacttacttgatg

SEQ ID NO: 642 - DNA, 56 bp, Artificial
  Synthetic oligonucleotide
tatccaagaccaacttggctgttcatgaagataaaaacagagtcccgtatgtaaag

SEQ ID NO: 643 - DNA, 88 bp, Artificial
  Synthetic oligonucleotide
gggtgcactgagcggtttgtgtcgagccctgaggaagtcatggatgtaatagatgaaggcaaagcaaaccgacacgtggctgtgacaa

SEQ ID NO: 644 - DNA, 105 bp, Artificial
  Synthetic oligonucleotide
gtcagcaaaactggtgccgagggagctgttcttgacgaagctaaaaatatcaataagtctttgtctgctcttggaaatgtgatctctgctttggcagaagggaca

SEQ ID NO: 645 - DNA, 61 bp, Artificial
  Synthetic oligonucleotide
ggtatgaaatcaaggcttaggtgcaaagccattggataccatacctgagaccacacagcca

SEQ ID NO: 646 - DNA, 69 bp, Artificial
  Synthetic oligonucleotide
gatgatgaaattaaccagcagagccagctggctgaaaagctgaagcaacagatgttggatcaggatgag

SEQ ID NO: 647 - DNA, 118 bp, Artificial
  Synthetic oligonucleotide
cacgaagccaagatcaagtctctgacagactacatgcagaacatggaacagaagaggaggcagctagaagagtcccaggactcgctcagcgaagagctggcaaagctccgagcccagg

SEQ ID NO: 648 - DNA, 77 bp, Artificial
  Synthetic oligonucleotide
aaaaaatgcacgaagtcagcttccaggataaggagaaggaacatctgacgcggttgcaggatgctgaagaaatgaag

SEQ ID NO: 649 - DNA, 110 bp, Artificial
  Synthetic oligonucleotide
aaggcgctggagcagcagatggagagccaccgggaagctcaccagaagcagctgtccagactccgagacgaaattgaggagaagcagaaaatcattgatgagattcggga

SEQ ID NO: 650 - DNA, 102 bp, Artificial
  Synthetic oligonucleotide
tttgaatcagaaactgcaactggaacaggagaagcttagttctgattataacaagctgaaaatagaggaccaagagagagaaatgaagctggaaaagctctt

SEQ ID NO: 651 - DNA, 61 bp, Artificial
  Synthetic oligonucleotide
attgctcaacgataaaagggaacaagccagagaagacctcaaagggctggaggagacagtg

SEQ ID NO: 652 - DNA, 72 bp, Artificial
  Synthetic oligonucleotide
tctagagaattgcagacactgcacaaccttcggaaactctttgtccaggatctgaccacccgagttaaaaaa

SEQ ID NO: 653 - DNA, 105 bp, Artificial
  Synthetic oligonucleotide
agtgtggagttggacaacgatgatggagggggcagtgctgcccagaagcagaaaatttccttcttggagaataacctggagcagctcaccaaagttcacaagcag

SEQ ID NO: 654 - DNA, 114 bp, Artificial
  Synthetic oligonucleotide
ccaagcccatccgccccggacactacccggcctcatctccaacggccgtccatgccattcgagggggaggaggcagctcttcaaattccactcactaccagaaataaatacaaa

SEQ ID NO: 655 - DNA, 118 bp, Artificial
  Synthetic oligonucleotide
gtgtgcccaagatgagtgagctggcactgtgccctgaagctttcaccactgtaatgaaatatatgccaggggagactttgggcttttctcatgactgtgtgggtcgaaggtagctcaa

SEQ ID NO: 656 - DNA, 6 bp, Artificial
  Synthetic oligonucleotide
gtgtgt

SEQ ID NO: 657 - DNA, 6 bp, Artificial
  Synthetic oligonucleotide
gtgtgt

SEQ ID NO: 658 - DNA, 55 bp, Artificial
  Synthetic oligonucleotide
ctaaaaaagccacatatgtgcaattttcaggtttttagactattgctccctgtac

SEQ ID NO: 659 - DNA, 160 bp, Artificial
  Synthetic oligonucleotide
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccg

SEQ ID NO: 660 - DNA, 133 bp, Artificial
  Synthetic oligonucleotide
atgtacccggagctgcagattgcacgtgtggagcaggctacgcaggccatccccatggagcgctggtgcgggggttcccggagcggcagctgcgcccacccccaccaccaggttgtgcccttccgctgcctgc

SEQ ID NO: 661 - DNA, 134 bp, Artificial
  Synthetic oligonucleotide
gcctgcagctcccagggcctcatcctgcacggctcgggcatgctcttaccctgtggctcggatcggttccgtggtgtggagtatgtgtgctgtccccctccagggacccccgacccatctgggacagcagttgg

SEQ ID NO: 662 - DNA, 179 bp, Artificial
  Synthetic oligonucleotide
tgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaag

SEQ ID NO: 663 - DNA, 131 bp, Artificial
  Synthetic oligonucleotide
tcactcccaccccgaggcccacagacggtgtggatatttactttggcatgcctggggaaatcagtgagcacgaggggttcctgagggccaagatggacctggaggagcgtaggatgcgccagattaatgag

SEQ ID NO: 664 - DNA, 159 bp, Artificial
  Synthetic oligonucleotide
cacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcag

SEQ ID NO: 665 - DNA, 129 bp, Artificial
  Synthetic oligonucleotide
gcggagcgtgtcctgttggccctgcggcgctacctgcgtgcggagcagaaggaacagaggcacacgctgcgccactaccagcatgtggccgccgtggatcccgagaaggcacagcagatgcgcttccag

SEQ ID NO: 666 - DNA, 1643 bp, Artificial
  Synthetic oligonucleotide
tcacatccttccagctcccaaatgcgccgctattcctcagacgcccgcgcctcaggctcttctcttgtcccttagaccctctttctgtctcttggaccccttcctatcccctgaacaccgcttctctgccccttcccagtctctcagctcagcttcctgaccctgaaacatggaccctcacatgctgtgtctttgacccctgcttcttggcccttggattcctactccccccgccgtcgatcctatgttctgtcccttggattttcactgcctttcccagaatcgtcttttttttttttttttttttgagacaggttcttgctctgtcgcccaggcaggagagcagtgtgcgatcttggctcattgcaacttccacctcctgggttcaagcaattctcctgcctcagcctctcgagtagctgggattacaggagcctgccaccacactgggctaatttttttttttttttttgacagagtctcgctctgtttcccaggctggagtgcagtgacatgatctgggctcactgcaacctccgcctactgggttcaagctattctcctgcctcagcctcctgagtagctgggactacaggcgggtgtcaccacatctggctgatttttgtatttttagtagagacagggtttcaccatactggtcaggctggtcttgaactcgacctcaggtgatccacccttggcctcctaaagtactcggattacaggtgtgagccaccacgcccggccccagctaatttttgtatttttggtagacacgggtttcagcatgttggccaggctggtcttgaactcctgacctcaggtgatctgcctgccttggcctcccaaagtgctgggattacaggcgtgagccaccatgcccagccagaaaccccaataacttttgcaccaatctaatatttttagcagagacagggttttgccatgttgcccaggctggtctcgaactcctgacctcaggtgatctgcccacctcggcctcccaaagtgctgggattacaggcgtgagccaccatgcccggccagaaaccccaataacttgcaccaatctaatatttttagcagagacagggttttgccatgttgcccaggctagtctcaaactcctgacctcaggtgatctgcctacctcggcctcccaaagtgctgggattacaggcatgagccaccgcgcccggtcgagaatctccttcttgttccttgaaccctcttcctgtccctcaacctcctttctccataacttcacttgttttccctggaacccctgttctgtgcgctcaaatttgaattcccctttcctggatgttttcttcctgtctatgaaactccattctgtgctcttgaactccaaatcttgccttgaaccatgtcatttctatatgaccctccaatcctcaatctctgtctctggaatcccctcaaaccccactttctgttccttggactttattcttcaatttccttctcctatggcccagttcctaacccttgtaccacacatcctgtccattgcatgtgccgcttttcctcagtcgctattgaattcctccttcatactgcttcagtttcctcatctccagcctgcattgcgcagttcatccttcatgtccactcacccacag

SEQ ID NO: 667 - DNA, 872 bp, Artificial
  Synthetic oligonucleotide
gtgagtgtctattaccctggctcccattacagatctctgagggcagatcttgactcctaaatgttgggcccccccaatttcatttattcctctataacaaacagcccagaccttagcagtgaaaatcaacaatgatttttctttgttcatgattctgccatccggtctgcgctcagcagagtggttctttcagtggtcttgccagtggtcaagcatgcagctgtatttagctagcagatcatctaggggctgggagtctagcacaaatggacctttctctctctccaaggaagcgcaaggcctctcttctccgtggagcttctccatgtggtctcatcagcagggtagctagattccctacatggtggtttatgctctctaagacatcacagtggaagttgctaggtcttaaggcttgggcccacattctatttgttaaagcaagttacaaattcagtccagattcaagggaaggaacctatatgcataccggaaagtgtgacctattgcagcccccacatctattgtgtctttctcctggatatctcacacataaccctgattctcctagtatttaagaaagctatcatcttgaggcgcggtggctcacgcctataatcccagcactttaggaggccgaggcgggtggatcacttgaggtcaggagttcgagaccagcctggccaacatggtgaaaccccgtctttactaaaaatacaaaaatcagccgggcatgatgtcgcttgcctgtaatcccagctacttaggaggctgaggcaagagaattgcttgaacccgggaggtggaggttgcagtgagctgagatcgcatcattgcactccagctgggcaacaagagtgagactctgtctc

SEQ ID NO: 668 - DNA, 259 bp, Artificial
  Synthetic oligonucleotide
gtgagtgagcccacatatagatgaccccagacattagggaacaggccccagcctaatttgtaatcccctagagtctgagggtgtcttcaccaccacagtgactgggagaggatgaggaggaacgtctaaggttgcaggggcctctgtaggatccccaatcctccttcttagtccctggaaggatgtttctccacctttctttgctgataccctcctctcttcactgttccactcccttgcttcctctggctgccagcag

SEQ ID NO: 669 - DNA, 463 bp, Artificial
  Synthetic oligonucleotide
gtgagtgtctcacagttaaccccagcctccaaatcccactgaatccctgaacccagaaggaaacagggtccatccattgggaacctcagaccccctggggtagagtttgatgtactttccagccccctcctctggaccctaaagaatgagatagggccaggcgctggtgactcacacccgtaatcctagcactttcagaggctgaggcaggaggatcccttgaggccacgagttctagaccagcctgggcaacataatgagaccctgtacctacaaataatttaaaaattacctgggtgtggtggggcatgtctgtagtcccagctgctcaggaggctgacgtagaaggatcactggagcccaggaagttgaggctgcagtgagctgagatcatgccactgcactccagcctgggtgacagagtgagactctgtctaaagaaaaaaaaaaagaatgagatcag

SEQ ID NO: 670 - DNA, 121 bp, Artificial
  Synthetic oligonucleotide
gtaagaggaggaacagccgggtacctaggggaagagaccagaggtcagcggccaggctgtgattcccaaagccacacaggaccctcaaagaagccctctgccccatctcctctccctgcag

SEQ ID NO: 671 - DNA, 144 bp, Artificial
  Synthetic oligonucleotide
gcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggag

SEQ ID NO: 672 - DNA, 304 bp, Artificial
  Synthetic oligonucleotide
aaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctaccaggccagtctga

SEQ ID NO: 673 - DNA, 44 bp, Artificial
  Synthetic oligonucleotide
ctgctcgcggtctaagtcgccgcccgggccagccgccgctgccg

SEQ ID NO: 674 - DNA, 20 bp, Artificial
  Synthetic oligonucleotide
ctgctgctgccactattgct

SEQ ID NO: 675 - DNA, 64 bp, Artificial
  Synthetic oligonucleotide
gctgcttctgcgcgcgcagcccgccatcgggagcctggccggtgggagccccggcgcggccgag

SEQ ID NO: 676 - DNA, 82 bp, Artificial
  Synthetic oligonucleotide
gccccggggtcggcccaggtggctggactatgcgggcgcctaacccttcaccgggacctgcgcaccggccgctgggaaccag

SEQ ID NO: 677 - DNA, 62 bp, Artificial
  Synthetic oligonucleotide
acccacagcgctctcgacgctgtctccgggacccgcagcgcgtgctggagtactgcagacag

SEQ ID NO: 678 - DNA, 113 bp, Artificial
  Synthetic oligonucleotide
ctggtgaatttgtgagtgaggccctgctggtgcctgaaggctgccggttcttgcaccaggagcgcatggaccaatgtgagagttcaacccggaggcatcaggaggcacaggag

SEQ ID NO: 679 - DNA, 75 bp, Artificial
  Synthetic oligonucleotide
gtgatgcgtgaatgggccatggcagacaaccagtccaagaacctgcctaaagccgacagacaggccctgaatgag

SEQ ID NO: 680 - DNA, 4 bp, Artificial
  Synthetic oligonucleotide
gtgc

SEQ ID NO: 681 - DNA, 72 bp, Artificial
  Synthetic oligonucleotide
gtgcatacccaccttcaagtgattgaggagagggtgaatcagagcctgggcctgcttgaccagaacccccac

SEQ ID NO: 682 - DNA, 28 bp, Artificial
  Synthetic oligonucleotide
ctggctcaggagctgcggccccaaatcc

SEQ ID NO: 683 - DNA, 108 bp, Artificial
  Synthetic oligonucleotide
aggaactcctccactctgaacacctgggtcccagtgaattggaagcccctgcccctgggggcagcagcgaggacaagggtgggctgcagcctccagattccaaggatg

SEQ ID NO: 684 - DNA, 24 bp, Artificial
  Synthetic oligonucleotide
acacccccatgacccttccaaaag

SEQ ID NO: 685 - DNA, 12 bp, Artificial
  Synthetic oligonucleotide
acttgggggtag

SEQ ID NO: 686 - DNA, 9 bp, Artificial
  Synthetic oligonucleotide
ggtccacag

SEQ ID NO: 687 - DNA, 62 bp, Artificial
  Synthetic oligonucleotide
aacaagatgctgcatcccctgagaaagagaagatgaacccgctggaacagtatgagcgaaag

SEQ ID NO: 688 - DNA, 63 bp, Artificial
  Synthetic oligonucleotide
gtgaatgcgtctgttccaaggggtttccctttccactcatcggagattcagagggatgagctg

SEQ ID NO: 689 - DNA, 36 bp, Artificial
  Synthetic oligonucleotide
gtggaccccatgctgaccctggaggagcagcagctc

SEQ ID NO: 690 - DNA, 39 bp, Artificial
  Synthetic oligonucleotide
cgcgaactgcagcggcacggctatgagaaccccacttac

SEQ ID NO: 691 - DNA, 59 bp, Artificial
  Synthetic oligonucleotide
cgcttcctggaggaacgaccctgacccggcccccttcaccccttcagccgagcccagac

SEQ ID NO: 692 - DNA, 17 bp, Artificial
  Synthetic oligonucleotide
ctcccctcttcctggag

SEQ ID NO: 693 - DNA, 6 bp, Artificial
  Synthetic oligonucleotide
ccccag

SEQ ID NO: 694 - protein, 20 aa, Artificial
  Synthetic peptide
GEGHSLPISPGVLQTQNCGP

SEQ ID NO: 695 - DNA, 307 bp, Artificial
  Synthetic oligonucleotide
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccag

SEQ ID NO: 696 - DNA, 447 bp, Artificial
  Synthetic oligonucleotide
gtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 697 - DNA, 523 bp, Artificial
  Synthetic oligonucleotide
gtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 698 - DNA, 1288 bp, Artificial
  Synthetic oligonucleotide
ctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttag

SEQ ID NO: 699 - DNA, 439 bp, Artificial
  Synthetic oligonucleotide
gctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 700 - DNA, 88 bp, Artificial
  Synthetic oligonucleotide
tccgggcgcggaggtttgcgcgccttggtgagccgttggcgtggtggtcccggagtgatcctggcagccggtggggaagacaaggagg

SEQ ID NO: 701 - DNA, 92 bp, Artificial
  Synthetic oligonucleotide
gtttgagcatggcagaaggaaacaccctgatatcagtggattatgaaatttttgggaaggtgcaaggggtgtttttccgtaagcatactcag

SEQ ID NO: 702 - DNA, 79 bp, Artificial
  Synthetic oligonucleotide
gaaatgactgttgaaaacagaattgctgaaactcacagcaagagctgtgttccagttagctttgctaccagttatgcag

SEQ ID NO: 703 - DNA, 77 bp, Artificial
  Synthetic oligonucleotide
ttttgagacagagtcttgctctgttgcctaggctaaagtgcagtagtgcgatctcggctcactgcaacctccacttc

SEQ ID NO: 704 - DNA, 114 bp, Artificial
  Synthetic oligonucleotide
ctttgtttttgggaggctgaggaaggaggatcatttgagcctgggaggttaaggctgcaataagctgtgactgtgccaccatccttcagaaaaaaaaaagaaaaaggaaaagag

SEQ ID NO: 705 - DNA, 49 bp, Artificial
  Synthetic oligonucleotide
ctatttaccatataagataactcttaagaactggagatagtcagctccc

SEQ ID NO: 706 - DNA, 287 bp, Artificial
  Synthetic oligonucleotide
gctacggaagggttttcagcagggagagatgggaccagcatgctctccatcctgttgccccgcctcacgtctggcccctgcttctccagtcccccaccccagaccacacacgaagaagcagtcctgtcctcagcccagccctcacctcccccgacctgccatcctgcttcatgctcagggcggtgtgtggagcgcccggggctctggacccgcgctgccagataacaatgctctcgttgtctctttgctcccatctctgggggcctctgattctttctgctctacag

SEQ ID NO: 707 - DNA, 138 bp, Artificial
  Synthetic oligonucleotide
ggccgttcctggccggttctccggagttacgatgactttcgttccctggatgcccacctccaccggtgcatatttgaccggaggttctcctgccttccggagcttcccccgccccccgagggtgccagggctgcccag

SEQ ID NO: 708 - DNA, 140 bp, Artificial
  Synthetic oligonucleotide
gcgtgtgccaccacgcccagcacagagagattttagatggcaaccgtgtggcatctgctgtggaggatgaaggtgcagaggtggatggggaagccttcaggtggggaagcctttgggtgggagagtcctgggacatgtga

SEQ ID NO: 709 - DNA, 123 bp, Artificial
  Synthetic oligonucleotide
ctggacaatcacggccggcgactgctcctcagtgaggaggcgtcactcaatatccctgcagtggcggccgcccatgtgatcaaacggtatacagcccaggcgccagatgagctgtcctttgag

SEQ ID NO: 710 - DNA, 153 bp, Artificial
  Synthetic oligonucleotide
ctgtgccacggcctcgtgggaagctggccggcctgctccgcaccttcatgcgctcccgcccttctcggcagcggctgcggcagcggggaatcctgcgacagagggtgtttggctgcgatcttggcgagcacctcagcaactcaggccaggatg

SEQ ID NO: 711 - DNA, 145 bp, Artificial
  Synthetic oligonucleotide
gcacgagtttgacagtgagaggatcccggagctgtctggccctgcattcctgcaggacatccacagcgtgtcctccctctgcaagctctacttccgagagcttccgaaccctctgctcacctaccagctctatgggaagttcagt

SEQ ID NO: 712 - DNA, 146 bp, Artificial
  Synthetic oligonucleotide
gtccatggagctggagtcagtgggaatgggtggcgcggcggcgttccgggaagttcgggtgcagtcggtggtggtggagtttctgctcacccatgtggacgtcctgttcagcgacaccttcacctccgccggcctcgaccctgcag

SEQ ID NO: 713 - DNA, 154 bp, Artificial
  Synthetic oligonucleotide
gccgctgcctgctccccaggcccaagtcccttgcgggcagctgcccctccacccgcctgctgacgctggaggaagcccaggcacgcacccagggccggctggggacgcccacggagcccacaactcccaaggccccggcctcacctgcggaaag

SEQ ID NO: 714 - DNA, 348 bp, Artificial
  Synthetic oligonucleotide
gcctccagaggctgcacaggctgcggcgaccccactccagcagcgacgctttccctgtgggcccagcacctgctggctcctgcgagagcctgtcctcgtcctcctcctccgagtcctcctcctctgagtcctcctcttcctcctctgagtcctcagcagctgggctgggggcactctctgggtctccctcacaccgtacctcagcctggctagatgatggtgatgagctggacttcagcccaccccgctgcctggagggactccgggggctggactttgatcccttaaccttccgctgcagcagccccaccccaggggatcccgcacctcccgccagcccagcacccc

SEQ ID NO: 715 - DNA, 123 bp, Artificial
  Synthetic oligonucleotide
ccgcccctgcctctgccttcccacccagggtgaccccccaggccatctcgccccgggggcccaccagccccgcctcgcctgctgccctagacatctcagagcccctggctgtatcagtgccac

SEQ ID NO: 716 - DNA, 177 bp, Artificial
  Synthetic oligonucleotide
aactgctgggggctgggggagcacctgcctcagccaccccaacaccagctctcagccccggccggagcctgcgcccccatctcatacccctgctgctgcgaggagccgaggccccgctgactgacgcctgccagcaggagatgtgcagcaagctccggggagcccagggcccactcg

SEQ ID NO: 717 - DNA, 392 bp, Artificial
  Synthetic oligonucleotide
gtcctgatatggagtcaccactgccaccccctcccctgtctctcctgcgccctgggggtgccccacccccgccccctaagaacccagcacgcctcatggccctggccctggctgagcgggctcagcaggtggccgagcaacagagccagcaggagtgtgggggcaccccacctgcttcccaatcccccttccaccgctcgctgtctctggaggtgggcggggagcccctggggacctcagggagtgggccacctcccaactccctagcacacccgggtgcctgggtcccgggacccccaccctacttaccaaggcaacaaagtgatgggagcctgctgaggagccagcggcccatggggacctcaaggaggggactccgaggccctgcccag

SEQ ID NO: 718 - DNA, 311 bp, Artificial
  Synthetic oligonucleotide
gttcctacccccggcttcttctccccagcccccagggagtgcctgccacccttcctcggggtccccaagccaggcttgtaccccctgggccccccatccttccagcccagttccccagccccagtctggaggagctctctgggcccccctgcaccactcgacaggggagagaacctgtactatgagatcggggcaagtgaggggtccccctattctggccccacccgctcctggagtccctttcgctccatgccccccgacaggctcaatgcctcctacggcatgcttggccaatcacccccactccacag

SEQ ID NO: 719 - DNA, 206 bp, Artificial
  Synthetic oligonucleotide
ctctacgtcaacctagctctagggcccaggggtccctcacctgcctcttcctcctcctcttcccctcctgcccacccccgaagccgttcagatcccggtcccccagtcccccgccttccccagaaacaacgggcaccctggggaccccgtacccctcatagggtgccgggtccctggggccctcctgagcctctcctgctctacag

SEQ ID NO: 720 - DNA, 426 bp, Artificial
  Synthetic oligonucleotide
ggcagccccgccagcctacggaagggggggcgagctccaccgagggtccttgtacagaaatggagggcaaagaggggagggggctggtcccccacccccttaccccactcccagctggtccctccactctgagggccagacccgaagctactgctgagcaccagctgggaggggccgtccttccttcccttcaccctcactggatcttggcccaaccaaatcccttgttttgtattttcttgaaccccgaccactaccccaggtttctaactttgtaacttgcttctgatgtgggtccctaacctataatctcagcttccctaccctggactgaagggtctgcccatccccccaccaccctccatcctgggggccctcgcacaaatctggggtgggaggggctaggctgaccccatcctcctctcc

SEQ ID NO: 721 - DNA, 98 bp, Artificial
  Synthetic oligonucleotide
gcacgcagcactgacagcctggatggcccaggggagggctcggtgcagcctctacccactgctggggggcccagtgtgaaggggaagcctgggaagag

SEQ ID NO: 722 - DNA, 85 bp, Artificial
  Synthetic oligonucleotide
gctctcagctcctcgaggccccttcccgcggctggctgactgcgcccatttccactacgagaacgttgactttggccacattcag

SEQ ID NO: 723 - DNA, 81 bp, Artificial
  Synthetic oligonucleotide
ctcctgctgtctccagaccgtgaagggcccagcctctctggagagaatgagctggtgttcggggtgcaggtgacctgtcag

SEQ ID NO: 724 - DNA, 93 bp, Artificial
  Synthetic oligonucleotide
atgctggtgccactgctgctgcagtacctggagacactgtcaggactggtggacagtaacctcaactgcgggcctgtgctcacctggatggag

SEQ ID NO: 725 - DNA, 46 bp, Artificial
  Synthetic oligonucleotide
gtgggcctgggcagggggcttggagattccgagtgggtgagggggt

SEQ ID NO: 726 - DNA, 78 bp, Artificial
  Synthetic oligonucleotide
gtgggagacattgtctcggtgatcgacatgccacccacagaggatcggagctggtggcggggcaagcgaggcttccag

SEQ ID NO: 727 - DNA, 67 bp, Artificial
  Synthetic oligonucleotide
gtcgggttcttccccagtgagtgtgtggaactcttcacagagcggccaggtccgggcctgaaggcgg

SEQ ID NO: 728 - DNA, 60 bp, Artificial
  Synthetic oligonucleotide
atgccgatggccccccatgtggcatcccggctccccagggtatctcgtctctgacctcag

SEQ ID NO: 729 - DNA, 103 bp, Artificial
  Synthetic oligonucleotide
tgccccaggtgctgcgctgctgctccgagttcattgaggcccacggggtggtggatgggatctaccggctctcaggcgtgtcttccaacatccagaggcttcg

SEQ ID NO: 730 - DNA, 83 bp, Artificial
  Synthetic oligonucleotide
gaggccatgtcagtgcctggggaggaggagcgtctggtgcgggtgcacgatgtcatccagcagctgcccccaccacattacag

SEQ ID NO: 731 - DNA, 108 bp, Artificial
  Synthetic oligonucleotide
gaccctggagtacctgctgaggcacctggcccgcatggcgagacacagtgccaacaccagcatgcatgcccgcaacctggccattgtctgggcacccaacctgctacg

SEQ ID NO: 732 - DNA, 89 bp, Artificial
  Synthetic oligonucleotide
gaggaaaggggagagaggggagaagcagcggaagccagggggcagcagctggaagacgttctttgcactgggccggggccccagtgtcc

SEQ ID NO: 733 - DNA, 57 bp, Artificial
  Synthetic oligonucleotide
ctcgaaagaagcccctgccctggctggggggcacccgtgccccaccgcagccttcag

SEQ ID NO: 734 - DNA, 75 bp, Artificial
  Synthetic oligonucleotide
gcagcagacccgacaccgtcacactgagatctgccaagagcgaggagtctctgtcatcgcaggccagcggggctg

SEQ ID NO: 735 - DNA, 12 bp, Artificial
  Synthetic oligonucleotide
ccgctgtcctag

SEQ ID NO: 736 - DNA, 84 bp, Artificial
  Synthetic oligonucleotide
gtcagtgcccagctcagggcaggtggcgggggcagggatgcgccagaggcagcagcccagtccccatgttctgtcccctcacag

SEQ ID NO: 737 - DNA, 50 bp, Artificial
  Synthetic oligonucleotide
gtcccccgacttcctgctcagctacccgccagccccctcctgctttcccc

SEQ ID NO: 738 - DNA, 62 bp, Artificial
  Synthetic oligonucleotide
ctgaccaccttggctactcagccccccagcaccctgctcggcgccctacaccgcctgagccc

SEQ ID NO: 739 - DNA, 6 bp, Artificial
  Synthetic oligonucleotide
ctccag

SEQ ID NO: 740 - DNA, 52 bp, Artificial
  Synthetic oligonucleotide
gagcccccagcatgtcctgacctgtgcacggggatggggggacaactcctac

SEQ ID NO: 741 - DNA, 67 bp, Artificial
  Synthetic oligonucleotide
ccttctttccccacatgccccactaaaccatctgacaacattaatgaataaaatggtgaaaatgtga

SEQ ID NO: 742 - DNA, 424 bp, Artificial
  Synthetic oligonucleotide
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggag

SEQ ID NO: 743 - DNA, 168 bp, Artificial
  Synthetic oligonucleotide
ctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccag

SEQ ID NO: 744 - DNA, 214 bp, Artificial
  Synthetic oligonucleotide
gtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaa

SEQ ID NO: 745 - DNA, 163 bp, Artificial
  Synthetic oligonucleotide
gtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgag

SEQ ID NO: 746 - DNA, 129 bp, Artificial
  Synthetic oligonucleotide
ggggacattcagcagtttttgatcacaggtgatcccaaggcagcatatgactactgtgagcattatagtccagactgtgactcttcagcacccaaggctgctcaagctcaggaacctcagatagatgag

SEQ ID NO: 747 - DNA, 215 bp, Artificial
  Synthetic oligonucleotide
gtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataa

SEQ ID NO: 748 - DNA, 214 bp, Artificial
  Synthetic oligonucleotide
ccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttg

SEQ ID NO: 749 - DNA, 430 bp, Artificial
  Synthetic oligonucleotide
gtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctatctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacag

SEQ ID NO: 750 - DNA, 639 bp, Artificial
  Synthetic oligonucleotide
atgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaa

SEQ ID NO: 751 - DNA, 129 bp, Artificial
  Synthetic oligonucleotide
gtaagtatgatgataataaatagccagacaatcatggttgtgaattacagctcttctttcattactctcatgctgtgattccacagtgtgtgggagagaaaataaacacatgtcaatcaaatcagtcaa

SEQ ID NO: 752 - DNA, 117 bp, Artificial
  Synthetic oligonucleotide
tatgcaccagaggatataatcgaatatgactatgagtatggggaagcagagtataaagaggctgaaagtgtaacagagggacccactgtaactgaggagacaatagcacagacggag

SEQ ID NO: 753 - DNA, 93 bp, Artificial
  Synthetic oligonucleotide
gcaaacatcgttgatgattttcaagaatacaactatggaacaatggaaagttaccagacagaagctcctaggcatgtttctgggacaaatgag

SEQ ID NO: 754 - DNA, 41 bp, Artificial
  Synthetic oligonucleotide
gtccaggtgtaccagcagaaactgatattacagaaacaagc

SEQ ID NO: 755 - DNA, 63 bp, Artificial
  Synthetic oligonucleotide
ataaatggccatggtgcatatggagagaaaggacagaaaggagaaccagcagtggttgagcct

SEQ ID NO: 756 - DNA, 42 bp, Artificial
  Synthetic oligonucleotide
ggtatgcttgtcgaaggaccaccaggaccagcaggacctgca

SEQ ID NO: 757 - DNA, 63 bp, Artificial
  Synthetic oligonucleotide
ggtattatgggtcctccaggtctacaaggccccactggaccccctggtgaccctggcgatagg

SEQ ID NO: 758 - DNA, 75 bp, Artificial
  Synthetic oligonucleotide
ggccccccaggacgtcctggcttaccaggggctgatggtctacctggtcctcctggtactatgttgatgttaccg

SEQ ID NO: 759 - DNA, 84 bp, Artificial
  Synthetic oligonucleotide
ttccgttatggtggtgatggttccaaaggaccaaccatctctgctcaggaagctcaggctcaagctattcttcagcaggctcgg

SEQ ID NO: 760 - DNA, 57 bp, Artificial
  Synthetic oligonucleotide
attgctctgagaggcccacctggcccaatgggtctaactggaagaccaggtcctgtg

SEQ ID NO: 761 - DNA, 54 bp, Artificial
  Synthetic oligonucleotide
ggggggcctggttcatctggggccaaaggtgagagtggtgatccaggtcctcag

SEQ ID NO: 762 - DNA, 54 bp, Artificial
  Synthetic oligonucleotide
ggccctcgaggcgtccagggtccccctggtccaacgggaaaacctggaaaaagg

SEQ ID NO: 763 - DNA, 54 bp, Artificial
  Synthetic oligonucleotide
ggtcgtccaggtgcagatggaggaagaggaatgccaggagaacctggggcaaag

SEQ ID NO: 764 - DNA, 54 bp, Artificial
  Synthetic oligonucleotide
ggagatcgagggtttgatggacttccgggtctgccaggtgacaaaggtcacagg

SEQ ID NO: 765 - DNA, 54 bp, Artificial
  Synthetic oligonucleotide
ggtgaacgaggtcctcaaggtcctccaggtcctcctggtgatgatggaatgagg

SEQ ID NO: 766 - DNA, 45 bp, Artificial
  Synthetic oligonucleotide
ggagaagatggagaaattggaccaagaggtcttccaggtgaagct

SEQ ID NO: 767 - DNA, 54 bp, Artificial
  Synthetic oligonucleotide
ggcccacgaggtttgctgggtccaaggggaactccaggagctccagggcagcct

SEQ ID NO: 768 - DNA, 45 bp, Artificial
  Synthetic oligonucleotide
ggtatggcaggtgtagatggccccccaggaccaaaagggaacatg

SEQ ID NO: 769 - DNA, 54 bp, Artificial
  Synthetic oligonucleotide
ggtccccaaggggagcctgggcctccaggtcaacaagggaatccaggacctcag

SEQ ID NO: 770 - DNA, 45 bp, Artificial
  Synthetic oligonucleotide
ggtcttcctggtccacaaggtccaattggtcctcctggtgaaaaa

SEQ ID NO: 771 - DNA, 54 bp, Artificial
  Synthetic oligonucleotide
ggaccacaaggaaaaccaggacttgctggacttcctggtgctgatgggcctcct

SEQ ID NO: 772 - DNA, 45 bp, Artificial
  Synthetic oligonucleotide
ggtcatcctgggaaagaaggccagtctggagaaaagggggctctg

SEQ ID NO: 773 - DNA, 54 bp, Artificial
  Synthetic oligonucleotide
ggtccccctggtccacaaggtcctattggatacccgggcccccggggagtaaag

SEQ ID NO: 774 - DNA, 45 bp, Artificial
  Synthetic oligonucleotide
ggagcagatggtgtcagaggtctcaagggatctaaaggtgaaaag

SEQ ID NO: 775 - DNA, 54 bp, Artificial
  Synthetic oligonucleotide
ggtgaagatggttttccaggattcaaaggtgacatgggtctaaaaggtgacaga

SEQ ID NO: 776 - DNA, 108 bp, Artificial
  Synthetic oligonucleotide
ggagaagttggtcaaattggcccaagaggggaagatggccctgaaggacccaaaggtcgagcaggcccaactggagacccaggtccttcaggtcaagcaggagaaaag

SEQ ID NO: 777 - DNA, 54 bp, Artificial
  Synthetic oligonucleotide
ggaaaacttggagttccaggattaccaggatatccaggaagacaaggtccaaag

SEQ ID NO: 778 - DNA, 54 bp, Artificial
  Synthetic oligonucleotide
ggttccactggattccctgggtttccaggtgccaatggagagaaaggtgcacgg

SEQ ID NO: 779 - DNA, 45 bp, Artificial
  Synthetic oligonucleotide
ggagtagctggcaaaccaggccctcggggtcagcgtggtccaacg

SEQ ID NO: 780 - DNA, 54 bp, Artificial
  Synthetic oligonucleotide
ggtcctcgaggttcaagaggtgcaagaggtcccactgggaaacctgggccaaag

SEQ ID NO: 781 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 782 - DNA, 45 bp, Artificial
  Synthetic oligonucleotide
ggcacttcaggtggcgatggccctcctggccctccaggtgaaaga

SEQ ID NO: 783 - DNA, 54 bp, Artificial
  Synthetic oligonucleotide
ggtcctcaaggacctcagggtccagttggattccctggaccaaaaggccctcct

SEQ ID NO: 784 - DNA, 54 bp, Artificial
  Synthetic oligonucleotide
ggaccacctgggaaggatgggctgccaggacaccctgggcaacgtggggagact

SEQ ID NO: 785 - DNA, 54 bp, Artificial
  Synthetic oligonucleotide
ggatttcaaggcaagaccggccctcctgggccagggggagtggttggaccacag

SEQ ID NO: 786 - DNA, 108 bp, Artificial
  Synthetic oligonucleotide
ggaccaaccggtgagactggtccaataggggaacgtgggcatcctggccctcctggccctcctggtgagcaaggtcttcctggtgctgcaggaaaagaaggtgcaaag

SEQ ID NO: 787 - DNA, 90 bp, Artificial
  Synthetic oligonucleotide
ggtgatccaggtcctcaaggtatctcagggaaagatggaccagcaggattacgtggtttcccaggggaaagaggtcttcctggagctcag

SEQ ID NO: 788 - DNA, 54 bp, Artificial
  Synthetic oligonucleotide
ggtgcacctggactgaaaggaggggaaggtccccagggcccaccaggtccagtt

SEQ ID NO: 789 - DNA, 211 bp, Artificial
  Synthetic oligonucleotide
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctgg

SEQ ID NO: 790 - DNA, 131 bp, Artificial
  Synthetic oligonucleotide
cccagatttaccaaagggaattgtcagctgtccaagggctagcaaattcctaggtcacctagattggattttctgaccataaaaactgtgggccaggtgcacagctgcctgaggggctcaaacctgtgcag

SEQ ID NO: 791 - DNA, 214 bp, Artificial
  Synthetic oligonucleotide
tcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaag

SEQ ID NO: 792 - DNA, 140 bp, Artificial
  Synthetic oligonucleotide
gccttatttctctgctggttgagcgaagggattgtcttccatggtctccgagatcccgtcccacgctcatgccctagaattctctgagtccttgatgcacttttgcctttggcgaggaggcaggacagtcaggcgtggag

SEQ ID NO: 793 - DNA, 143 bp, Artificial
  Synthetic oligonucleotide
ctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 794 - DNA, 130 bp, Artificial
  Synthetic oligonucleotide
ccccacccatctgggccccgggttcaagagagagcggggtctgatctcgtgtagccatatagagtttgcttctgagtgtctgctttgtttagtagaggtgggcaggaggagctgaggggctggggctggg

SEQ ID NO: 795 - DNA, 140 bp, Artificial
  Synthetic oligonucleotide
ctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 796 - DNA, 93 bp, Artificial
  Synthetic oligonucleotide
tgtctctgagagcattgatgaggtcaggaagcctcctgttgggtagaggagcaactaagagactgaacttggcccccaccctgaggctcacaa

SEQ ID NO: 797 - DNA, 103 bp, Artificial
  Synthetic oligonucleotide
gcttgaattgcacctgagttccaaaggagaagttgacattcttccagaacatatgcccagtgtcttcaacttgagatggagctgggatgccaagtctgcaaat

SEQ ID NO: 798 - DNA, 47 bp, Artificial
  Synthetic oligonucleotide
cttggctggaggctctgcgaggacagctggggagaaggggagctgtg

SEQ ID NO: 799 - DNA, 18 bp, Artificial
  Synthetic oligonucleotide
atggaggctcgctctgtt

SEQ ID NO: 800 - DNA, 98 bp, Artificial
  Synthetic oligonucleotide
gccaggctggagtacagcgatctcggctcactgcaacctctgcctcccgggttcaagtgattctcctgcctcagcctcccaagtagctgggactacag

SEQ ID NO: 801 - DNA, 96 bp, Artificial
  Synthetic oligonucleotide
gtataaaaacgcccttgggaccaggcagcctcaaaccccagctgttggggccaggacacccagtgagcccatacttgctctttttgtcttcttcag

SEQ ID NO: 802 - DNA, 78 bp, Artificial
  Synthetic oligonucleotide
actgcgccatggggctcagcgacggggaatggcagttggtgctgaacgtctgggggaaggtggaggctgacatcccag

SEQ ID NO: 803 - DNA, 25 bp, Artificial
  Synthetic oligonucleotide
gccatgggcaggaagtcctcatcag

SEQ ID NO: 804 - DNA, 80 bp, Artificial
  Synthetic oligonucleotide
gctctttaagggtcacccagagactctggagaagtttgacaagttcaagcacctgaagtcagaggacgagatgaaggcgt

SEQ ID NO: 805 - DNA, 84 bp, Artificial
  Synthetic oligonucleotide
ttcatctcggaatgcatcatccaggttctgcagagcaagcatcccggggactttggtgctgatgcccagggggccatgaacaag

SEQ ID NO: 806 - DNA, 29 bp, Artificial
  Synthetic oligonucleotide
gccctggagctgttccggaaggacatggc

SEQ ID NO: 807 - DNA, 28 bp, Artificial
  Synthetic oligonucleotide
ctccaactacaaggagctgggcttccag

SEQ ID NO: 808 - DNA, 23 bp, Artificial
  Synthetic oligonucleotide
ggctaggcccctgccgctcccac

SEQ ID NO: 809 - DNA, 13 bp, Artificial
  Synthetic oligonucleotide
gtgttgaagttgg

SEQ ID NO: 810 - DNA, 22 bp, Artificial
  Synthetic oligonucleotide
ctttgcatgcccagcgatgcgc

SEQ ID NO: 811 - DNA, 45 bp, Artificial
  Synthetic oligonucleotide
ctccctgtgggatgtcatcaccctgggaaccgggagtggcccttg

SEQ ID NO: 812 - DNA, 56 bp, Artificial
  Synthetic oligonucleotide
gctcactgtgttctgcatggtttggatctgaattaattgtcctttcttctaaatcc

SEQ ID NO: 813 - DNA, 118 bp, Artificial
  Synthetic oligonucleotide
caaccgaacttcttccaacctccaaactggctgtaaccccaaatccaagccattaactacacctgacagtagcaattgtctgattaatcactggccccttgaagacagcagaatgtcc

SEQ ID NO: 814 - DNA, 178 bp, Artificial
  Synthetic oligonucleotide
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacag

SEQ ID NO: 815 - DNA, 278 bp, Artificial
  Synthetic oligonucleotide
cctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccag

SEQ ID NO: 816 - DNA, 400 bp, Artificial
  Synthetic oligonucleotide
gtgagtatatctgctcctctctggcccaggctgccagcccaaatccacagggccagaggcaggatttctcagtccctctcaggttcaagtacacagaccctcaaccctggacatccagactgtctgtgactttctgccccagaaaaacctgggcagaccaagtcttgaccaagaataggaggggaggggctgcttctgtcctgggaggctcagggtccacaccctatgatgggagaaacaggtgaatatctcagactcaggctcagtagatacaagaggggtttggctgagactttaggattgtgattcagcttagagggacactgtggtccttccatagaccaggaacttccacttccctctgacaatatcacctgtggctttattttgtttgctccag

SEQ ID NO: 817 - DNA, 255 bp, Artificial
  Synthetic oligonucleotide
atggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatg

SEQ ID NO: 818 - DNA, 190 bp, Artificial
  Synthetic oligonucleotide
ctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctg

SEQ ID NO: 819 - DNA, 127 bp, Artificial
  Synthetic oligonucleotide
ctgtccaatggcaacaggaccctcactctattcaatgtcacaagaaatgacgcaagagcctatgtatgtggaatccagaactcagtgagtgcaaaccgcagtgacccagtcaccctggatgtcctct

SEQ ID NO: 820 - DNA, 255 bp, Artificial
  Synthetic oligonucleotide
atgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctg

SEQ ID NO: 821 - DNA, 1174 bp, Artificial
  Synthetic oligonucleotide
ctggggtggagtctatctggttctcaccaaagagccaagaagacattttctttcccagtctgtgttccatgggcacaaggaaatcccaaattctatcctgagccccctcactccatctcggccaactctctcctccccggcttctctgatatctcacggctgacctcgggtccagcctggaatgtggggaggggcctcccttagccccagaaggcccccaatagtgaaagggacttcatagtccagaagaaagaagggtccttaaggtcgagttgctcctctctatcaccaatatgtccctttctgtcacctctttgtgttttttcacctactctgtgagctacaaggaacaaggaggctttgaaaccagcccacactttttccccaaatgagaggaggaagccccttggatgaggcaggagcagctcagactctgctccctgctctgcgcccggctcacccggtgactggctctgccctggctccacttggggtgggaccggggcatgtggagaaggtgtccaggtggcctgttttgaatctgggtaaatcaagctgccaatccacagcagagcctcccttgggtcaggttgcagggaaatgggaaaagagggagcctcgggacagactcctgagctgtgtcctggctctgaagtcactggctgtatgaggctgtggacacagcacataggacacagcagaggaaagtgagtgacacacacttggagaaatagggagattcagccataggggctctgcatgggagggaacaggcagtgccaaaaagtgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaaaaaaaaaaaaaaagg

SEQ ID NO: 822 - DNA, 179 bp, Artificial
  Synthetic oligonucleotide
ctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgagg

SEQ ID NO: 823 - DNA, 732 bp, Artificial
  Synthetic oligonucleotide
tttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtataacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtcaa

SEQ ID NO: 824 - DNA, 280 bp, Artificial
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 825 - DNA, 82 bp, Artificial
  Synthetic oligonucleotide
aatgacacaggattctacaccctacacgtcataaagtcagatcttgtgaatgaagaagcaactggccagttccgggtatacc

SEQ ID NO: 826 - DNA, 104 bp, Artificial
  Synthetic oligonucleotide
cggagctgcccaagccctccatctccagcaacaactccaaacccgtggaggacaaggatgctgtggccttcacctgtgaacctgagactcaggacgcaacctac

SEQ ID NO: 827 - DNA, 48 bp, Artificial
  Synthetic oligonucleotide
ctgtggtgggtaaacaatcagagcctcccggtcagtcccaggctgcag

SEQ ID NO: 828 - DNA, 48 bp, Artificial
  Synthetic oligonucleotide
ctgtccaatggcaacaggaccctcactctattcaatgtcacaagaaat

SEQ ID NO: 829 - DNA, 79 bp, Artificial
  Synthetic oligonucleotide
gacacagcaagctacaaatgtgaaacccagaacccagtgagtgccaggcgcagtgattcagtcatcctgaatgtcctct

SEQ ID NO: 830 - DNA, 3 bp, Artificial
  Synthetic oligonucleotide
cag

SEQ ID NO: 831 - DNA, 6 bp, Artificial
  Synthetic oligonucleotide
agccac

SEQ ID NO: 832 - DNA, 7 bp, Artificial
  Synthetic oligonucleotide
ccaaacc

SEQ ID NO: 833 - DNA, 18 bp, Artificial
  Synthetic oligonucleotide
cttcatcaccagcaacaa

SEQ ID NO: 834 - DNA, 70 bp, Artificial
  Synthetic oligonucleotide
ctccaaccccgtggaggatgaggatgctgtagccttaacctgtgaacctgagattcagaacacaacctac

SEQ ID NO: 835 - DNA, 24 bp, Artificial
  Synthetic oligonucleotide
ctgtggtgggtaaataatcagagc

SEQ ID NO: 836 - DNA, 24 bp, Artificial
  Synthetic oligonucleotide
ctcccggtcagtcccaggctgcag

SEQ ID NO: 837 - DNA, 78 bp, Artificial
  Synthetic oligonucleotide
ctgtccaatgacaacaggaccctcactctactcagtgtcacaaggaatgatgtaggaccctatgagtgtggaatccag

SEQ ID NO: 838 - DNA, 30 bp, Artificial
  Synthetic oligonucleotide
aacgaattaagtgttgaccacagcgaccca

SEQ ID NO: 839 - DNA, 19 bp, Artificial
  Synthetic oligonucleotide
gtcatcctgaatgtcctct

SEQ ID NO: 840 - DNA, 19 bp, Artificial
  Synthetic oligonucleotide
atggcccagacgaccccac

SEQ ID NO: 841 - DNA, 18 bp, Artificial
  Synthetic oligonucleotide
catttccccctcatacac

SEQ ID NO: 842 - DNA, 28 bp, Artificial
  Synthetic oligonucleotide
ctattaccgtccaggggtgaacctcagc

SEQ ID NO: 843 - DNA, 22 bp, Artificial
  Synthetic oligonucleotide
cggagctgcccaagccctccat

SEQ ID NO: 844 - DNA, 82 bp, Artificial
  Synthetic oligonucleotide
ctccagcaacaactccaaacccgtggaggacaaggatgctgtggccttcacctgtgaacctgaggctcagaacacaacctac

SEQ ID NO: 845 - DNA, 48 bp, Artificial
  Synthetic oligonucleotide
ctgtggtgggtaaatggtcagagcctcccagtcagtcccaggctgcag

SEQ ID NO: 846 - DNA, 33 bp, Artificial
  Synthetic oligonucleotide
gtaagtggctccctggagcatcagcatcatatt

SEQ ID NO: 847 - DNA, 27 bp, Artificial
  Synthetic oligonucleotide
catctggaacttctcctggtctctcag

SEQ ID NO: 848 - DNA, 92 bp, Artificial
  Synthetic oligonucleotide
ctggggccactgtcggcatcatgattggagtgctggttggggttgctctgatatagcagccctggtgtagtttcttcatttcaggaagactg

SEQ ID NO: 849 - DNA, 26 bp, Artificial
  Synthetic oligonucleotide
acagttgttttgcttcttccttaaag

SEQ ID NO: 850 - DNA, 101 bp, Artificial
  Synthetic oligonucleotide
catttgcaacagctacagtctaaaattgcttctttaccaaggatatttacagaaaagactctgaccagagatcgagaccatcctagccaacatcgtgaaac

SEQ ID NO: 851 - DNA, 34 bp, Artificial
  Synthetic oligonucleotide
cccatctctactaaaaatacaaaaatgagctggg

SEQ ID NO: 852 - DNA, 44 bp, Artificial
  Synthetic oligonucleotide
cttggtggcgcgcacctgtagtcccagttactcgggaggctgag

SEQ ID NO: 853 - DNA, 4 bp, Artificial
  Synthetic oligonucleotide
gcag

SEQ ID NO: 854 - DNA, 88 bp, Artificial
  Synthetic oligonucleotide
gagaatcgcttgaacccgggaggtggagattgcagtgagcccagatcgcaccactgcactccagtctggcaacagagcaagactccat

SEQ ID NO: 855 - DNA, 30 bp, Artificial
  Synthetic oligonucleotide
ataatattttcataattttttatttgaaat

SEQ ID NO: 856 - DNA, 266 bp, Artificial
  Synthetic oligonucleotide
tgccacctcacccactgcctctgcctccctggggcagagctgttcccagacgggtggggcggggcccaactgtccccagctccttcagccctttctgtccctcccagtgaggccagctgcggtgaagagggtgctctcttgcctggagttccctctgctacggctgccccctcccagccctggcccactaagccagacccagctgtcgccattcccacttctggtcctgccacctcctgagctgccttcccgcctggtctgggtag

SEQ ID NO: 857 - DNA, 166 bp, Artificial
  Synthetic oligonucleotide
agtcatggcctcgagcacaggtgaccggagccaggcggtgaggcatggactgagggcgaaggtgctgacgctggacggcatgaacccgcgtgtgcggagagtggagtacgcagtgcgtggccccatagtgcagcgagccttggagctggagcaggagctgcgccag

SEQ ID NO: 858 - DNA, 134 bp, Artificial
  Synthetic oligonucleotide
gggcctacagcgtcagctccggcatccagctgatccgggaggacgtggcgcggtacattgagaggcgtgacggaggcatccctgcggaccccaacaacgtcttcctgtccacaggggccagcgatgccatcgtg

SEQ ID NO: 859 - DNA, 190 bp, Artificial
  Synthetic oligonucleotide
acggtgctgaagctgctggtggccggcgagggccacacacgcacgggtgtgctcatccccatcccccagtacccactctactcggccacgctggcagagctgggcgcagtgcaggtggattactacctggacgaggagcgtgcctgggcgctggacgtggccgagcttcaccgtgcactgggccaggcgc

SEQ ID NO: 860 - DNA, 137 bp, Artificial
  Synthetic oligonucleotide
gtgtaccaggacaacgtgtacgccgcgggttcgcagttccactcattcaagaaggtgctcatggagatggggccgccctacgccgggcagcaggagcttgcctccttccactccacctccaagggctacatgggcga

SEQ ID NO: 861 - DNA, 175 bp, Artificial
  Synthetic oligonucleotide
gtgcgggttccgcggcggctatgtggaggtggtgaacatggacgctgcagtgcagcagcagatgctgaagctgatgagtgtgcggctgtgcccgccggtgccaggacaggccctgctggacctggtggtcagcccgcccgcgcccaccgacccctcctttgcgcagttccaggct

SEQ ID NO: 862 - DNA, 156 bp, Artificial
  Synthetic oligonucleotide
gagaagcaggcagtgctggcagagctggcggccaaggccaagctcaccgagcaggtcttcaatgaggctcctggcatcagctgcaacccagtgcagggcgccatgtactccttcccgcgcgtgcagctgcccccgcgggcggtggagcgcgctcag

SEQ ID NO: 863 - DNA, 2023 bp, Artificial
  Synthetic oligonucleotide
gagccctgggaggctctggagcccactgtacttgctcttgatgcctggcggggtggggtggggggggtgctgggcccctgcctctctgcaggtccctaataaagctgtgtggcagtctgactccaaaaaggaagcgttggcagctgcgtggcccgctcccacctgcctacccttcttgcaggcctgagtcccttcagagaagggaccttccacggccaccacccacctcttcctcctgaagaccccgtgcccaccataggctgggtcttccctctggcctctggttgtggggcagagcccgtcagatcacacagaaatgggttgagagggtccagagtgtgaggaaagcgcaggccccacacccctttgtggaagcccccaagaatctagggagccaggggcccaggtggccacccgaagaaacacagcctttcctgaggaaggcacagtgaactgcctccttcctggctccctttcctgtgaggtccatgtcttccctggggcagggggaaatactaaaccagcatggtgctggctggtcagggtgactgacagctcaggaaggaagtcttggttctcttacccaaggaagcaggggtggggccactgtctggggggccagagaccacctttggtgtcattgtgtggtgcagtccttcggctgggtggagtgggaggcagagggagaggataagggagcgtcccaggggagggctggggctggaggaggcaggggctgggctgagcgggagtgggcagcgctgtgtcctggcctggggagcatggctgagcacctactacatgcagacactgctggggggtcactcaatctgcacagatgctcttctgaagtaggcatgatagtccccatttgatagacgtggaaacctgcaacccaaaaacctgctgagctgacaagaaaccccctcagaggcctcggcagccagaaaaatgcgttgggtccagtgccctcaagtccgccaaggacatgggctggctttagagactcacaaacttgggagataggactggccaagggcacctggtttttttcgctctggagatggttcttaaccacaggccacacacacttcacagcctcatctggccctcgggagccccagagggcacagctctgggcaggagacacagcaggtgggcccctcccttggcagggcgggctcgaatcaggcagggtgctcctagccttgtcaccggacaccgaagggcgtcacgggcagtggctggcggtgtccttctgagctaagctgggtcctgacctttcacacttccctcctaacttccatggctctgtcaccgccttacggaggagctgaagccacagacacagcaaggttggggtccgcaccggaagtatccagtggtagacggcggaacccttaagaaacggacgccttcatgcgggcggctggagaagcgggggctgggcactgcagcaaccacgcttcggctgacaccaggaaggaagcacgcctggagcggatccgaaactactgagaggggccagggctggccgtgggcgcaggccgatccttacattcgaggccggcccagctctgtagcttccccctctgggcctctcacccgcgcaggacctcggtgggagcgcgcacgtggcggggcggggggccgcgggcccgagcccggactggccaccgggggcgcccgcgagctgacgctctggcccgttgcggtctctgtggcccgcgcgaccttccggccctggagccggtggccgcggggctccagcgacgccgtgtggtccgtgctccgctctgtggctccagggggccgagaaactgctgagagtccggcccggccggcagtgctgggcgcgggccgagggccccgggaggcagcggccccgccctctttacctgcggcctcgcagagcatgctgggagccgcgggaggcagtggccccgctcccctcacctgcggtatcgcagagcatggtgggagccccgggaggcagtggccccgcccccttccctgcggccgc

SEQ ID NO: 864 - DNA, 90 bp, Artificial
  Synthetic oligonucleotide
ggtgtgaagaagcctttcaccgaggtcatccgtgccaacatcggggacgcacaggctatggggcagaggcccatcaccttcctgcgccag

SEQ ID NO: 865 - DNA, 109 bp, Artificial
  Synthetic oligonucleotide
gtcttggccctctgtgttaaccctgatcttctgagcagccccaacttccctgacgatgccaagaaaagggcggagcgcatcttgcaggcgtgtgggggccacagtctgg

SEQ ID NO: 866 - DNA, 54 bp, Artificial
  Synthetic oligonucleotide
gtgaccactgccgccctcgtgcgctctgtgtcatcaaccctggcaaccccaccg

SEQ ID NO: 867 - DNA, 80 bp, Artificial
  Synthetic oligonucleotide
ggcaggtgcagacccgcgagtgcatcgaggccgtgatccgcttcgccttcgaagagcggctctttctgctggcggacgag

SEQ ID NO: 868 - DNA, 67 bp, Artificial
  Synthetic oligonucleotide
gtgcgcggcgcgggggagcgggaagccgggcaacagtccgcccccgtgacgccttgcgcccttccag

SEQ ID NO: 869 - DNA, 100 bp, Artificial
  Synthetic oligonucleotide
gtgcgtgcgtacgaggcgggtgggggctcgcgggccatggccaggccctcctcgcccgatgggccaccccctcctccgcacctgacctggccgtgcgcag

SEQ ID NO: 870 - DNA, 74 bp, Artificial
  Synthetic oligonucleotide
gtcaggcgggggcggggcctgcggggtgggcagggggggccgggcatccctctctgacggctctccgtccacag

SEQ ID NO: 871 - DNA, 73 bp, Artificial
  Synthetic oligonucleotide
gagctgggcctggcccccgatatgttcttctgcctgcgcctcctggaggagaccggcatctgcgtggtgccag

SEQ ID NO: 872 - DNA, 40 bp, Artificial
  Synthetic oligonucleotide
ggagcggctttgggcagcgggaaggcacctaccacttccg

SEQ ID NO: 873 - DNA, 66 bp, Artificial
  Synthetic oligonucleotide
gtgaggcctggccctcactccctgtcccgccaccctggcccttcactcactgtcaactcctttcag

SEQ ID NO: 874 - DNA, 81 bp, Artificial
  Synthetic oligonucleotide
gatgaccattctgccccccttggagaaactgcggctgctgctggagaagctgagcaggttccatgccaagttcaccctcga

SEQ ID NO: 875 - DNA, 57 bp, Artificial
  Synthetic oligonucleotide
gtactcctgagcaccccagctggggccaggctgggtcgccctggactgtgtgctcag

SEQ ID NO: 876 - DNA, 582 bp, Artificial
  Synthetic oligonucleotide
gtaagcaggggatgagggcacactgagctccctccagccctctcagcctcaaccctctggaggcccaggcatatgggcagggggactcctgaaccctactccaagcacagcctctgtctgactcccttgtccttcaagagaactgttctccaggtctcagggccaggatttccataggatcgcctgtggctttgattctattctagtgtctctgggtgggggtcctgggcaagtgtctttctgagtctcagtttctttatcggtaaaatgtacataatgagattgaaagtgctctgcaaagcactatgtgcactaagaatttattattcaggttgtttccatcatgttttctgaggtgaaatcacaaaggatcagtggagtttgaggattatctagttcaatgctttgagtttagagttttacggtgaaaatgagacttgtctcctgacactaagtctctctcaactatagcgctatcttgctattttctctatctcagaaggatccttgggcaggaggaaggatgtggatatgatttggctggtttctatgctgaagctcttatctgattttctctcacag

SEQ ID NO: 877 - DNA, 193 bp, Artificial
  Synthetic oligonucleotide
cttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcaaaacctgcttct

SEQ ID NO: 878 - DNA, 190 bp, Artificial
  Synthetic oligonucleotide
gtgaaaagagacatcacaagcaattgagggaccaggaagtggatcctctagagatgaggaggcattctgctggatgacttttaaaaatgttttctccagagtcatctctctcattaacaatgttttttgtcttagaaatttcttgttgatttttaaacttacatgatttcttgttttggtatgaatacag

SEQ ID NO: 879 - DNA, 179 bp, Artificial
  Synthetic oligonucleotide
gctgcttcagtccttcaataagcccatcacactttttcaccatgtcatctatcagcactttttctgcagtgttacgaacatcagcttcatcactgtcagcctgcgttttgcctgcaacccatcaaatgaggtcaggagaggagttttccacttttggcttcatgttggtgctcaaaact

SEQ ID NO: 880 - DNA, 208 bp, Artificial
  Synthetic oligonucleotide
gtttcctgcttatgcaatagtagctgggagaggccgaaagaattctggtggggccacacccactggtgaaagaataaatagtgaggtttggcattggccatcagagtcactcctgccttcaccatgaagtccagcggcctcttccccttcctggtgctgcttgccctgggaactctggcaccttgggctgtggaaggctctggaaagt

SEQ ID NO: 881 - DNA, 37 bp, Artificial
  Synthetic oligonucleotide
ccttcaaagctggagtctgtcctcctaagaaatctgc

SEQ ID NO: 882 - DNA, 112 bp, Artificial
  Synthetic oligonucleotide
ccagtgccttagatacaagaaacctgagtgccagagtgactggcagtgtccagggaagaagagatgttgtcctgacacttgtggcatcaaatgcctggatcctgttgacacc

SEQ ID NO: 883 - DNA, 10 bp, Artificial
  Synthetic oligonucleotide
ccaaacccaa

SEQ ID NO: 884 - DNA, 4 bp, Artificial
  Synthetic oligonucleotide
caag

SEQ ID NO: 885 - DNA, 56 bp, Artificial
  Synthetic oligonucleotide
gaggaagcctgggaagtgcccagtgacttatggccaatgtttgatgcttaaccccc

SEQ ID NO: 886 - DNA, 90 bp, Artificial
  Synthetic oligonucleotide
ccaatttctgtgagatggatggccagtgcaagcgtgacttgaagtgttgcatgggcatgtgtgggaaatcctgcgtttcccctgtgaaag

SEQ ID NO: 887 - DNA, 131 bp, Artificial
  Synthetic oligonucleotide
caagcccagcagccccggggcggatggctccggccgcctggctccgcagcgcggccgcgcgcgccctcctgcccccgatgctgctgctgctgctccagccgccgccgctgctggcccgggctctgccgccg

SEQ ID NO: 888 - DNA, 182 bp, Artificial
  Synthetic oligonucleotide
gacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagag

SEQ ID NO: 889 - DNA, 144 bp, Artificial
  Synthetic oligonucleotide
gatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccag

SEQ ID NO: 890 - DNA, 134 bp, Artificial
  Synthetic oligonucleotide
gtactggcatggggacgacctgccgtttgatgggcctgggggcatcctggcccatgccttcttccccaagactcaccgagaaggggatgtccacttcgactatgatgagacctggactatcggggatgaccagg

SEQ ID NO: 891 - DNA, 183 bp, Artificial
  Synthetic oligonucleotide
acaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggag

SEQ ID NO: 892 - DNA, 217 bp, Artificial
  Synthetic oligonucleotide
ccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaag

SEQ ID NO: 893 - DNA, 138 bp, Artificial
  Synthetic oligonucleotide
agctgggatttccatcctcaactggcagagatgagagcctggagcattgcagatgccagggacttcacaaatgaaggcacagcatgggaaacctgcgtgggttccagggcagtccagcctgcaggggcccagggagtg

SEQ ID NO: 894 - DNA, 300 bp, Artificial
  Synthetic oligonucleotide
gtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcag

SEQ ID NO: 895 - DNA, 142 bp, Artificial
  Synthetic oligonucleotide
gtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcag

SEQ ID NO: 896 - DNA, 927 bp, Artificial
  Synthetic oligonucleotide
gtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcag

SEQ ID NO: 897 - DNA, 911 bp, Artificial
  Synthetic oligonucleotide
gctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 898 - DNA, 48 bp, Artificial
  Synthetic oligonucleotide
gttcgtgctttctggcgggcgctgggagaagacggacctcacctacag

SEQ ID NO: 899 - DNA, 41 bp, Artificial
  Synthetic oligonucleotide
gcacagacctgctgcaggtggcagcccatgaatttggccac

SEQ ID NO: 900 - DNA, 18 bp, Artificial
  Synthetic oligonucleotide
gtgctggggctgcagcac

SEQ ID NO: 901 - DNA, 92 bp, Artificial
  Synthetic oligonucleotide
gtgaggccctgcctgccagtccccctactcctctgctggccactgtgactgcagcatatgccctcagcatgtgtccctctctcccaccccag

SEQ ID NO: 902 - DNA, 116 bp, Artificial
  Synthetic oligonucleotide
ggactactggcgtttccaccccagcacccggcgtgtagacagtcccgtgccccgcagggccactgactggagaggggtgccctctgagatcgacgctgccttccaggatgctgatg

SEQ ID NO: 903 - DNA, 359 bp, Artificial
  Synthetic oligonucleotide
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgt

SEQ ID NO: 904 - DNA, 586 bp, Artificial
  Synthetic oligonucleotide
ctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 905 - DNA, 111 bp, Artificial
  Synthetic oligonucleotide
ggaaagtgcatcttcctaagggcgagggtttcagcagtggttgaactcggcggggtggggcggagcgggaggatgcaaacttgcaaagtgaagcaaacacactcaccgcag

SEQ ID NO: 906 - DNA, 44 bp, Artificial
  Synthetic oligonucleotide
cccagcaagggctctggcagctgacagggctttgtctgggacag

SEQ ID NO: 907 - DNA, 97 bp, Artificial
  Synthetic oligonucleotide
ctgcaaaccagtgtgccgtgccagccaaggacagggtggactgcggctacccccatgtcacccccaaggagtgcaacaaccggggctgctgctttga

SEQ ID NO: 908 - DNA, 50 bp, Artificial
  Synthetic oligonucleotide
ctccaggatccctggagtgccttggtgtttcaagcccctgcaggaagcag

SEQ ID NO: 909 - DNA, 19 bp, Artificial
  Synthetic oligonucleotide
aatgcaccttctgaggcac

SEQ ID NO: 910 - DNA, 1133 bp, Artificial
  Synthetic oligonucleotide
tgagacaagatgtcactctgtcacccaggctggagtgcagtggcaggatcacggctcactgcagcctcgacctccctgggctcaggtgatcctcccacctcagcctaccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagacttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggcattgcgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacag

SEQ ID NO: 911 - DNA, 790 bp, Artificial
  Synthetic oligonucleotide
ctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcacaaaggtgacgcagatgtgggtgccctgctcctgcccagcagcagtgcttggtggaggctgaggccctgcacaggcaccctcactgctgaccttgagcctctctctcctctag

SEQ ID NO: 912 - DNA, 643 bp, Artificial
  Synthetic oligonucleotide
agtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgatcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccactcattgaacctgggcccctccatctctccaaacagcatgttttcttcaagtaacatact

SEQ ID NO: 913 - DNA, 1298 bp, Artificial
  Synthetic oligonucleotide
ctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtg

SEQ ID NO: 914 - DNA, 170 bp, Artificial
  Synthetic oligonucleotide
ggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacag

SEQ ID NO: 915 - DNA, 143 bp, Artificial
  Synthetic oligonucleotide
cggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccag

SEQ ID NO: 916 - DNA, 148 bp, Artificial
  Synthetic oligonucleotide
ggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcgg

SEQ ID NO: 917 - DNA, 168 bp, Artificial
  Synthetic oligonucleotide
ctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccag

SEQ ID NO: 918 - DNA, 578 bp, Artificial
  Synthetic oligonucleotide
cagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtc

SEQ ID NO: 919 - DNA, 691 bp, Artificial
  Synthetic oligonucleotide
ggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagaga

SEQ ID NO: 920 - DNA, 131 bp, Artificial
  Synthetic oligonucleotide
ctaaaaatacgaggaaaggagagtgaggattttcattaaaagtctcagcagtgggtttcttgggttatttaaaacatcacctaaataggccttttcttcctaattggccatcaaattaaagcctatccttt

SEQ ID NO: 921 - DNA, 247 bp, Artificial
  Synthetic oligonucleotide
ctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccag

SEQ ID NO: 922 - DNA, 126 bp, Artificial
  Synthetic oligonucleotide
gacacagtttactgatctctgttctagtgagtgggtcaaaaagcatatgcatccttatccgtcaactcatcagctcttcctcaaggcaacctgaggccagacaccaagaaaccaagcgtatctgct

SEQ ID NO: 923 - DNA, 231 bp, Artificial
  Synthetic oligonucleotide
ctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccag

SEQ ID NO: 924 - DNA, 1079 bp, Artificial
  Synthetic oligonucleotide
ctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggct

SEQ ID NO: 925 - DNA, 38 bp, Artificial
  Synthetic oligonucleotide
ggaggaggaggggaagcggcgaaggaggaagaggagga

SEQ ID NO: 926 - DNA, 41 bp, Artificial
  Synthetic oligonucleotide
gagctcccagcagaaaggccgcctgtccctgcagaatacag

SEQ ID NO: 927 - DNA, 11 bp, Artificial
  Synthetic oligonucleotide
ctgcccaggag

SEQ ID NO: 928 - DNA, 53 bp, Artificial
  Synthetic oligonucleotide
aacacccgggtgatagtggagatgatccatttcaaggacttgctgctgcacga

SEQ ID NO: 929 - DNA, 73 bp, Artificial
  Synthetic oligonucleotide
atgctacaagatagaaattactatgcccaagaggaggaaagtgaagctaagagattagagaactcggactgag

SEQ ID NO: 930 - DNA, 33 bp, Artificial
  Synthetic oligonucleotide
accctacgtggacctcgtgaacttgctgctgac

SEQ ID NO: 931 - DNA, 12 bp, Artificial
  Synthetic oligonucleotide
ggcccaccacgg

SEQ ID NO: 932 - DNA, 30 bp, Artificial
  Synthetic oligonucleotide
ggaagcaggacatcacctcccagagcccag

SEQ ID NO: 933 - DNA, 103 bp, Artificial
  Synthetic oligonucleotide
tccgcggaagtcagggcggctggattccaggacaggagtgaatgtaaaaataaatatcgcttagaatgcaggagaagggtggagaggaggcaggggccgaggg

SEQ ID NO: 934 - DNA, 77 bp, Artificial
  Synthetic oligonucleotide
ggtgcttggtgccaaactgaaattcagtttcttgtgtggggccttgcggttcagagctcttggcgagggtggaggga

SEQ ID NO: 935 - DNA, 5 bp, Artificial
  Synthetic oligonucleotide
cagaa

SEQ ID NO: 936 - DNA, 17 bp, Artificial
  Synthetic oligonucleotide
ctgaatttcactcacag

SEQ ID NO: 937 - DNA, 167 bp, Artificial
  Synthetic oligonucleotide
ttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctg

SEQ ID NO: 938 - DNA, 142 bp, Artificial
  Synthetic oligonucleotide
gtcggcaaccacattgatgtgctcactggcaagtgggtggcccaggacgcaggcatcggggctggcgtggactcctactttgagtacttggtgaaaggagccatcctgcttcaggataagaagctcatggccatgttcctag

SEQ ID NO: 939 - DNA, 125 bp, Artificial
  Synthetic oligonucleotide
agtataacaaagccatccggaactacacccgcttcgatgactggtacctgtgggttcagatgtacaaggggactgtgtccatgccagtcttccagtccttggaggcctactggcctggtcttcag

SEQ ID NO: 940 - DNA, 145 bp, Artificial
  Synthetic oligonucleotide
agcctcattggagacattgacaatgccatgaggaccttcctcaactactacactgtatggaagcagtttggggggctcccggaattctacaacattcctcagggatacacagtggagaagcgagagggctacccacttcggccag

SEQ ID NO: 941 - DNA, 172 bp, Artificial
  Synthetic oligonucleotide
aagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaag

SEQ ID NO: 942 - DNA, 375 bp, Artificial
  Synthetic oligonucleotide
ctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatca

SEQ ID NO: 943 - DNA, 122 bp, Artificial
  Synthetic oligonucleotide
aaaagatctcgctctgttgcccaggctggagtgcagtggtgtgatcacgactcaccgcagccttgacctcccacactcaagcaatcctcctgccttagccttccaagtagctggaactccag

SEQ ID NO: 944 - DNA, 105 bp, Artificial
  Synthetic oligonucleotide
ggattcccggaagaacccgcagcagctcccaggatgaactggttgcagtggctgctgctgctgcgggggcgctgagaggacacgagctctatgcctttccggctg

SEQ ID NO: 945 - DNA, 92 bp, Artificial
  Synthetic oligonucleotide
ctcatcccgctcggcctcctgtgcgcgctgctgcctcagcaccatggtgcgccaggtcccgacggctccgcgccagatcccgcccactacag

SEQ ID NO: 946 - DNA, 102 bp, Artificial
  Synthetic oligonucleotide
ggagcgagtcaaggccatgttctaccacgcctacgacagctacctggagaatgcctttcccttcgatgagctgcgacctctcacctgtgacgggcacgacac

SEQ ID NO: 947 - DNA, 9 bp, Artificial
  Synthetic oligonucleotide
ctggggcag

SEQ ID NO: 948 - DNA, 40 bp, Artificial
  Synthetic oligonucleotide
tttttctctgactctaattgatgcactggacaccttgctg

SEQ ID NO: 949 - DNA, 106 bp, Artificial
  Synthetic oligonucleotide
attttggggaatgtctcagaattccaaagagtggttgaagtgctccaggacagcgtggactttgatattgatgtgaacgcctctgtgtttgaaacaaacattcgag

SEQ ID NO: 950 - DNA, 6 bp, Artificial
  Synthetic oligonucleotide
tggtag

SEQ ID NO: 951 - DNA, 27 bp, Artificial
  Synthetic oligonucleotide
gaggactcctgtctgctcatctgctct

SEQ ID NO: 952 - DNA, 93 bp, Artificial
  Synthetic oligonucleotide
ccaagaaggctggggtggaagtagaggctggatggccctgttccgggcctctcctgagaatggctgaggaggcggcccgaaaactcctcccag

SEQ ID NO: 953 - DNA, 35 bp, Artificial
  Synthetic oligonucleotide
cctttcagacccccactggcatgccatatggaaca

SEQ ID NO: 954 - DNA, 10 bp, Artificial
  Synthetic oligonucleotide
gtgaacttac

SEQ ID NO: 955 - DNA, 89 bp, Artificial
  Synthetic oligonucleotide
aacttattgaaagcgcaatgtacctctaccgtgccacgggggatcccaccctcctagaactcggaagagatgctgtggaatccattgaa

SEQ ID NO: 956 - DNA, 33 bp, Artificial
  Synthetic oligonucleotide
aaaatcagcaaggtggagtgcggatttgcaaca

SEQ ID NO: 957 - DNA, 20 bp, Artificial
  Synthetic oligonucleotide
cttgcttccttctcccacat

SEQ ID NO: 958 - DNA, 5 bp, Artificial
  Synthetic oligonucleotide
gtcag

SEQ ID NO: 959 - DNA, 21 bp, Artificial
  Synthetic oligonucleotide
atcaaagatctgcgagaccac

SEQ ID NO: 960 - DNA, 74 bp, Artificial
  Synthetic oligonucleotide
gtggtggttaattttatgtgtcaacctggctggaccactgggtactccgatatttggtcaaacattattctgag

SEQ ID NO: 961 - DNA, 184 bp, Artificial
  Synthetic oligonucleotide
gtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaag

SEQ ID NO: 962 - DNA, 189 bp, Artificial
  Synthetic oligonucleotide
cactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaa

SEQ ID NO: 963 - DNA, 266 bp, Artificial
  Synthetic oligonucleotide
gtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcag

SEQ ID NO: 964 - DNA, 164 bp, Artificial
  Synthetic oligonucleotide
actgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgag

SEQ ID NO: 965 - DNA, 230 bp, Artificial
  Synthetic oligonucleotide
agtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatc

SEQ ID NO: 966 - DNA, 136 bp, Artificial
  Synthetic oligonucleotide
tggtgtgaataaatcttttatcttgaatgtaataagaatttggtggtgtcaattgcttatttgttttcccacggttgtccagcaattaataaaacataaccttttttactgcctatataatgtttttaaaggttta

SEQ ID NO: 967 - DNA, 26 bp, Artificial
  Synthetic oligonucleotide
gaaaactcactaccatgagaattgca

SEQ ID NO: 968 - DNA, 42 bp, Artificial
  Synthetic oligonucleotide
gtgatttgcttttgcctcctaggcatcacctgtgccatacca

SEQ ID NO: 969 - DNA, 39 bp, Artificial
  Synthetic oligonucleotide
gttaaacaggctgattctggaagttctgaggaaaagcag

SEQ ID NO: 970 - DNA, 87 bp, Artificial
  Synthetic oligonucleotide
gtaagcatcttttatgtttttatatagttaaatcatttactcaattatggcgagaggtgcaagaaacgtatttgctgcgatattact

SEQ ID NO: 971 - DNA, 81 bp, Artificial
  Synthetic oligonucleotide
ctttacaacaaatacccagatgctgtggccacatggctaaaccctgacccatctcagaagcagaatctcctagccccacag

SEQ ID NO: 972 - DNA, 42 bp, Artificial
  Synthetic oligonucleotide
aatgctgtgtcctctgaagaaaccaatgactttaaacaagag

SEQ ID NO: 973 - DNA, 8 bp, Artificial
  Synthetic oligonucleotide
acccttcc

SEQ ID NO: 974 - DNA, 50 bp, Artificial
  Synthetic oligonucleotide
aagtaagtccaacgaaagccatgaccacatggatgatatggatgatgaag

SEQ ID NO: 975 - DNA, 65 bp, Artificial
  Synthetic oligonucleotide
atgatgatgaccatgtggacagccaggactccattgactcgaacgactctgatgatgtagatgac

SEQ ID NO: 976 - DNA, 37 bp, Artificial
  Synthetic oligonucleotide
gtcaaaatctaagaagtttcgcagacctgacatccag

SEQ ID NO: 977 - DNA, 18 bp, Artificial
  Synthetic oligonucleotide
taccctgatgctacagac

SEQ ID NO: 978 - DNA, 26 bp, Artificial
  Synthetic oligonucleotide
gaggacatcacctcacacatggaaag

SEQ ID NO: 979 - DNA, 52 bp, Artificial
  Synthetic oligonucleotide
cgaggagttgaatggtgcatacaaggccatccccgttgcccaggacctgaac

SEQ ID NO: 980 - DNA, 51 bp, Artificial
  Synthetic oligonucleotide
gcgccttctgattgggacagccgtgggaaggacagttatgaaacgagtcag

SEQ ID NO: 981 - DNA, 12 bp, Artificial
  Synthetic oligonucleotide
ctggatgaccag

SEQ ID NO: 982 - DNA, 34 bp, Artificial
  Synthetic oligonucleotide
ttctgaggtcaattaaaaggagaaaaaatacaat

SEQ ID NO: 983 - DNA, 41 bp, Artificial
  Synthetic oligonucleotide
ttctcactttgcatttagtcaaaagaaaaaatgctttatag

SEQ ID NO: 984 - DNA, 36 bp, Artificial
  Synthetic oligonucleotide
caaaatgaaagagaacatgaaatgcttctttctcag

SEQ ID NO: 985 - DNA, 119 bp, Artificial
  Synthetic oligonucleotide
tttattggttgaatgtgtatctatttgagtctggaaataactaatgtgtttgataattagtttagtttgtggcttcatggaaactccctgtaaactaaaagcttcagggttatgtctat

SEQ ID NO: 986 - DNA, 11 bp, Artificial
  Synthetic oligonucleotide
gttcattctat

SEQ ID NO: 987 - DNA, 91 bp, Artificial
  Synthetic oligonucleotide
agaagaaatgcaaactatcactgtattttaatatttgttattctctcatgaatagaaatttatgtagaagcaaacaaaatacttttaccca

SEQ ID NO: 988 - DNA, 18 bp, Artificial
  Synthetic oligonucleotide
cttaaaaagagaatataa

SEQ ID NO: 989 - DNA, 6 bp, Artificial
  Synthetic oligonucleotide
catttt

SEQ ID NO: 990 - DNA, 60 bp, Artificial
  Synthetic oligonucleotide
atgtcactataatcttttgttttttaagttagtgtatattttgttgtgattatctttttg

SEQ ID NO: 991 - DNA, 153 bp, Artificial
  Synthetic oligonucleotide
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 992 - DNA, 744 bp, Artificial
  Synthetic oligonucleotide
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 993 - DNA, 174 bp, Artificial
  Synthetic oligonucleotide
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 994 - DNA, 309 bp, Artificial
  Synthetic oligonucleotide
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 995 - DNA, 487 bp, Artificial
  Synthetic oligonucleotide
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 996 - DNA, 418 bp, Artificial
  Synthetic oligonucleotide
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattagataaagcagtgtttgtattttaaaggatgtctgcacaa

SEQ ID NO: 997 - DNA, 44 bp, Artificial
  Synthetic oligonucleotide
gctttgcgctgcaaatccagtgctaccagtgtgaagaattccag

SEQ ID NO: 998 - DNA, 94 bp, Artificial
  Synthetic oligonucleotide
ctgaacaacgactgctcctcccccgagttcattgtgaattgcacggtgaacgttcaagacatgtgtcagaaagaagtgatggagcaaagtgccg

SEQ ID NO: 999 - DNA, 4 bp, Artificial
  Synthetic oligonucleotide
acag

SEQ ID NO: 1000 - DNA, 58 bp, Artificial
  Synthetic oligonucleotide
ggatcatgtaccgcaagtcctgtgcatcatcagcggcctgtctcatcgcctctgccgg

SEQ ID NO: 1001 - DNA, 11 bp, Artificial
  Synthetic oligonucleotide
ctgaagctgaa

SEQ ID NO: 1002 - DNA, 63 bp, Artificial
  Synthetic oligonucleotide
ggagatgccaccccctcctgcattgttcttccagccctcgcccccaaccccccacctccctga

SEQ ID NO: 1003 - DNA, 30 bp, Artificial
  Synthetic oligonucleotide
tctgaaaagtgcttaagaaaatcttctcag

SEQ ID NO: 1004 - DNA, 84 bp, Artificial
  Synthetic oligonucleotide
ttctccttgcagaggactggcgccgggacgcgaagagcaacgggcgctgcacaaagcgggcgctgtcggtggtggagtgcgcat

SEQ ID NO: 1005 - DNA, 26 bp, Artificial
  Synthetic oligonucleotide
gtacgcgcaggcgcttctcgtggttg

SEQ ID NO: 1006 - DNA, 113 bp, Artificial
  Synthetic oligonucleotide
gcgtgctgcagcgacaggcggcagcacagcacctgcacgaacacccgccgaaactgctgcgaggacaccgtgtacaggagcgggttgatgaccgagctgaggtagaaaaacgt

SEQ ID NO: 1007 - DNA, 82 bp, Artificial
  Synthetic oligonucleotide
ctccgagaaggggaggaggatcatgtacgcccggaagtaggacctcgtccagtcgtgcttgggtttggccgcagccatgatc

SEQ ID NO: 1008 - DNA, 24 bp, Artificial
  Synthetic oligonucleotide
ctccgaatctggttgggcatccag

SEQ ID NO: 1009 - DNA, 28 bp, Artificial
  Synthetic oligonucleotide
catacggccaatgtcacaacaatcagcc

SEQ ID NO: 1010 - DNA, 10 bp, Artificial
  Synthetic oligonucleotide
ctccgcggca

SEQ ID NO: 1011 - DNA, 21 bp, Artificial
  Synthetic oligonucleotide
ctgggcagacacgagcaggag

SEQ ID NO: 1012 - DNA, 52 bp, Artificial
  Synthetic oligonucleotide
gcagcgcgggccccagcagcctcggcagccacagccgctgcagccggggcag

SEQ ID NO: 1013 - DNA, 43 bp, Artificial
  Synthetic oligonucleotide
cctccgctgctgtcgcctcctctgatgcgcttgccctctcccg

SEQ ID NO: 1014 - DNA, 32 bp, Artificial
  Synthetic oligonucleotide
gccccgggactccgggagaatgtgggtcctag

SEQ ID NO: 1015 - DNA, 39 bp, Artificial
  Synthetic oligonucleotide
gcatcgcggcaactttttgcggattgttcttgcttccag

SEQ ID NO: 1016 - DNA, 34 bp, Artificial
  Synthetic oligonucleotide
gtgagaatacccagaggccagcagccgaggccag

SEQ ID NO: 1017 - DNA, 438 bp, Artificial
  Synthetic oligonucleotide
gtggaggaggatggtggggagtggtggtgtcttcgtcctgggagaaggcgaagcaacttccaggaggaaacgggcgtttccttcccacgcgctcgagcgagccctgggtcctggcctcggaactccacccagcccctccccaccctctgggaaaagccagtcgccacacacaggcacacgcaggccccggcgccgcgccctaaggagagcagcacccacagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaagggaaagc

SEQ ID NO: 1018 - DNA, 122 bp, Artificial
  Synthetic oligonucleotide
gtaatcctgctccctctgctgtttgacctcttctcctgcagctaagtgaagctgcttcctcccttctcttttgtattccccttcccagagggcgataagcaaataataataatgcaataaat

SEQ ID NO: 1019 - DNA, 90 bp, Artificial
  Synthetic oligonucleotide
ctgagcatgcagagtgtgcagagcacgagcttttgtctccgaaagcagtgcctttgcctgaccttcctgcttctccatctcctgggacag

SEQ ID NO: 1020 - DNA, 111 bp, Artificial
  Synthetic oligonucleotide
gtcgctgcgactcagcgctgccctccccagtgcccgggccagtgccctgcgacgccgccgacctgcgcccccggggtgcgcgcggtgctggacggctgctcatgctgtctg

SEQ ID NO: 1021 - DNA, 115 bp, Artificial
  Synthetic oligonucleotide
gtgtgtgcccgccagcgtggcgagagctgctcagatctggagccatgcgacgagagcagtggcctctactgtgatcgcagcgcggaccccagcaaccagactggcatctgcacgg

SEQ ID NO: 1022 - DNA, 232 bp, Artificial; identical to SEQ ID NO: 151
  Synthetic oligonucleotide

SEQ ID NO: 1023 - DNA, 189 bp, Artificial; identical to SEQ ID NO: 152
  Synthetic oligonucleotide

SEQ ID NO: 1024 - DNA, 201 bp, Artificial; identical to SEQ ID NO: 153
  Synthetic oligonucleotide

SEQ ID NO: 1025 - DNA, 698 bp, Artificial; identical to SEQ ID NO: 154
  Synthetic oligonucleotide

SEQ ID NO: 1026 - DNA, 86 bp, Artificial; identical to SEQ ID NO: 155
  Synthetic oligonucleotide

SEQ ID NO: 1027 - DNA, 7 bp, Artificial
  Synthetic oligonucleotide
gataaga

SEQ ID NO: 1028 - DNA, 203 bp, Artificial; identical to SEQ ID NO: 157
  Synthetic oligonucleotide

SEQ ID NO: 1029 - DNA, 229 bp, Artificial; identical to SEQ ID NO: 158
  Synthetic oligonucleotide

SEQ ID NO: 1030 - DNA, 336 bp, Artificial; identical to SEQ ID NO: 159
  Synthetic oligonucleotide

SEQ ID NO: 1031 - DNA, 125 bp, Artificial; identical to SEQ ID NO: 160
  Synthetic oligonucleotide

SEQ ID NO: 1032 - DNA, 1305 bp, Artificial; identical to SEQ ID NO: 161
  Synthetic oligonucleotide

SEQ ID NO: 1033 - DNA, 404 bp, Artificial; identical to SEQ ID NO: 162
  Synthetic oligonucleotide

SEQ ID NO: 1034 - DNA, 184 bp, Artificial; identical to SEQ ID NO: 163
  Synthetic oligonucleotide

SEQ ID NO: 1035 - DNA, 97 bp, Artificial; identical to SEQ ID NO: 164
  Synthetic oligonucleotide

SEQ ID NO: 1036 - DNA, 91 bp, Artificial; identical to SEQ ID NO: 165
  Synthetic oligonucleotide

SEQ ID NO: 1037 - DNA, 65 bp, Artificial; identical to SEQ ID NO: 166
  Synthetic oligonucleotide

SEQ ID NO: 1038 - DNA, 65 bp, Artificial; identical to SEQ ID NO: 167
  Synthetic oligonucleotide

SEQ ID NO: 1039 - DNA, 810 bp, Artificial; identical to SEQ ID NO: 168
  Synthetic oligonucleotide

SEQ ID NO: 1040 - DNA, 168 bp, Artificial; identical to SEQ ID NO: 169
  Synthetic oligonucleotide

SEQ ID NO: 1041 - DNA, 157 bp, Artificial; identical to SEQ ID NO: 170
  Synthetic oligonucleotide

SEQ ID NO: 1042 - DNA, 198 bp, Artificial
  Synthetic oligonucleotide
gtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcag

SEQ ID NO: 1043 - DNA, 153 bp, Artificial; identical to SEQ ID NO: 172
  Synthetic oligonucleotide

SEQ ID NO: 1044 - DNA, 140 bp, Artificial; identical to SEQ ID NO: 173
  Synthetic oligonucleotide

SEQ ID NO: 1045 - DNA, 127 bp, Artificial; identical to SEQ ID NO: 174
  Synthetic oligonucleotide

SEQ ID NO: 1046 - DNA, 223 bp, Artificial; identical to SEQ ID NO: 175
  Synthetic oligonucleotide

SEQ ID NO: 1047 - DNA, 9 bp, Artificial
  Synthetic oligonucleotide
ctgaccaag

SEQ ID NO: 1048 - DNA, 44 bp, Artificial; identical to SEQ ID NO: 177
  Synthetic oligonucleotide

SEQ ID NO: 1049 - DNA, 38 bp, Artificial; identical to SEQ ID NO: 178
  Synthetic oligonucleotide

SEQ ID NO: 1050 - DNA, 14 bp, Artificial
  Synthetic oligonucleotide
ctttgccttccgag

SEQ ID NO: 1051 - DNA, 32 bp, Artificial; identical to SEQ ID NO: 180
  Synthetic oligonucleotide

SEQ ID NO: 1052 - DNA, 24 bp, Artificial
  Synthetic oligonucleotide
gtgaggcctgggtaccccaagctc

SEQ ID NO: 1053 - DNA, 84 bp, Artificial; identical to SEQ ID NO: 182
  Synthetic oligonucleotide

SEQ ID NO: 1054 - DNA, 42 bp, Artificial; identical to SEQ ID NO: 183
  Synthetic oligonucleotide

SEQ ID NO: 1055 - DNA, 51 bp, Artificial; identical to SEQ ID NO: 184
  Synthetic oligonucleotide

SEQ ID NO: 1056 - DNA, 9 bp, Artificial
  Synthetic oligonucleotide
gcatggcac

SEQ ID NO: 1057 - DNA, 95 bp, Artificial; identical to SEQ ID NO: 186
  Synthetic oligonucleotide

SEQ ID NO: 1058 - DNA, 42 bp, Artificial; identical to SEQ ID NO: 187
  Synthetic oligonucleotide

SEQ ID NO: 1059 - DNA, 8 bp, Artificial
  Synthetic oligonucleotide
tcccgccg

SEQ ID NO: 1060 - DNA, 7 bp, Artificial
  Synthetic oligonucleotide
atggccg

SEQ ID NO: 1061 - DNA, 17 bp, Artificial
  Synthetic oligonucleotide
ggccctctgtagctccc

SEQ ID NO: 1062 - DNA, 62 bp, Artificial; identical to SEQ ID NO: 191
  Synthetic oligonucleotide

SEQ ID NO: 1063 - DNA, 20 bp, Artificial
  Synthetic oligonucleotide
agaagtgccagtgtgacgag

SEQ ID NO: 1064 - DNA, 58 bp, Artificial; identical to SEQ ID NO: 193
  Synthetic oligonucleotide

SEQ ID NO: 1065 - DNA, 6 bp, Artificial
  Synthetic oligonucleotide
ctcaag

SEQ ID NO: 1066 - DNA, 20 bp, Artificial
  Synthetic oligonucleotide
gcctgagacccttcatccag

SEQ ID NO: 1067 - DNA, 327 bp, Artificial; identical to SEQ ID NO: 196
  Synthetic oligonucleotide

SEQ ID NO: 1068 - DNA, 177 bp, Artificial; identical to SEQ ID NO: 197
  Synthetic oligonucleotide

SEQ ID NO: 1069 - DNA, 240 bp, Artificial; identical to SEQ ID NO: 198
  Synthetic oligonucleotide

SEQ ID NO: 1070 - DNA, 300 bp, Artificial; identical to SEQ ID NO: 199
  Synthetic oligonucleotide

SEQ ID NO: 1071 - DNA, 152 bp, Artificial; identical to SEQ ID NO: 200
  Synthetic oligonucleotide

SEQ ID NO: 1072 - DNA, 176 bp, Artificial; identical to SEQ ID NO: 201
  Synthetic oligonucleotide

SEQ ID NO: 1073 - DNA, 129 bp, Artificial; identical to SEQ ID NO: 202
  Synthetic oligonucleotide

SEQ ID NO: 1074 - DNA, 279 bp, Artificial; identical to SEQ ID NO: 203
  Synthetic oligonucleotide

SEQ ID NO: 1075 - DNA, 853 bp, Artificial; identical to SEQ ID NO: 280
  Synthetic oligonucleotide

SEQ ID NO: 1076 - DNA, 162 bp, Artificial; identical to SEQ ID NO: 281
  Synthetic oligonucleotide

SEQ ID NO: 1077 - DNA, 130 bp, Artificial; identical to SEQ ID NO: 282
  Synthetic oligonucleotide

SEQ ID NO: 1078 - DNA, 217 bp, Artificial; identical to SEQ ID NO: 283
  Synthetic oligonucleotide

SEQ ID NO: 1079 - DNA, 256 bp, Artificial; identical to SEQ ID NO: 284
  Synthetic oligonucleotide

SEQ ID NO: 1080 - DNA, 176 bp, Artificial; identical to SEQ ID NO: 285
  Synthetic oligonucleotide

SEQ ID NO: 1081 - DNA, 143 bp, Artificial; identical to SEQ ID NO: 286
  Synthetic oligonucleotide

SEQ ID NO: 1082 - DNA, 124 bp, Artificial; identical to SEQ ID NO: 287
  Synthetic oligonucleotide

SEQ ID NO: 1083 - DNA, 588 bp, Artificial; identical to SEQ ID NO: 288
  Synthetic oligonucleotide

SEQ ID NO: 1084 - DNA, 585 bp, Artificial; identical to SEQ ID NO: 289
  Synthetic oligonucleotide

SEQ ID NO: 1085 - DNA, 1188 bp, Artificial; identical to SEQ ID NO: 290
  Synthetic oligonucleotide

SEQ ID NO: 1086 - DNA, 45 bp, Artificial; identical to SEQ ID NO: 291
  Synthetic oligonucleotide

SEQ ID NO: 1087 - DNA, 28 bp, Artificial
  Synthetic oligonucleotide
attattcaaccaggatacctaattcaag

SEQ ID NO: 1088 - DNA, 15 bp, Artificial
  Synthetic oligonucleotide
aacatccgacccaac

SEQ ID NO: 1089 - DNA, 40 bp, Artificial; identical to SEQ ID NO: 294
  Synthetic oligonucleotide

SEQ ID NO: 1090 - DNA, 74 bp, Artificial; identical to SEQ ID NO: 295
  Synthetic oligonucleotide

SEQ ID NO: 1091 - DNA, 96 bp, Artificial; identical to SEQ ID NO: 296
  Synthetic oligonucleotide

SEQ ID NO: 1092 - DNA, 59 bp, Artificial; identical to SEQ ID NO: 297
  Synthetic oligonucleotide

SEQ ID NO: 1093 - DNA, 92 bp, Artificial; identical to SEQ ID NO: 298
  Synthetic oligonucleotide

SEQ ID NO: 1094 - DNA, 57 bp, Artificial; identical to SEQ ID NO: 299
  Synthetic oligonucleotide

SEQ ID NO: 1095 - DNA, 97 bp, Artificial; identical to SEQ ID NO: 300
  Synthetic oligonucleotide

SEQ ID NO: 1096 - DNA, 95 bp, Artificial; identical to SEQ ID NO: 301
  Synthetic oligonucleotide

SEQ ID NO: 1097 - DNA, 66 bp, Artificial; identical to SEQ ID NO: 302
  Synthetic oligonucleotide

SEQ ID NO: 1098 - DNA, 34 bp, Artificial; identical to SEQ ID NO: 303
  Synthetic oligonucleotide

SEQ ID NO: 1099 - DNA, 53 bp, Artificial; identical to SEQ ID NO: 304
  Synthetic oligonucleotide

SEQ ID NO: 1100 - DNA, 95 bp, Artificial; identical to SEQ ID NO: 305
  Synthetic oligonucleotide

SEQ ID NO: 1101 - DNA, 148 bp, Artificial
  Synthetic oligonucleotide
ggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacag

SEQ ID NO: 1102 - DNA, 190 bp, Artificial
  Synthetic oligonucleotide
ataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcag

SEQ ID NO: 1103 - DNA, 194 bp, Artificial
  Synthetic oligonucleotide
atgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaag

SEQ ID NO: 1104 - DNA, 270 bp, Artificial
  Synthetic oligonucleotide
gctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagag

SEQ ID NO: 1105 - DNA, 127 bp, Artificial
  Synthetic oligonucleotide
aaacccatgtatgaagtacagtggaaggttgttgaggagataaatggaaacaattatgtttacatagacccaacacaacttccttatgatcacaaatgggagtttcccagaaacaggctgagttttg

SEQ ID NO: 1106 - DNA, 151 bp, Artificial
  Synthetic oligonucleotide
ggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctg

SEQ ID NO: 1107 - DNA, 125 bp, Artificial
  Synthetic oligonucleotide
gtaaatgcttggctttctgcagtgctgtgctttcaagaatttaatatcctgctcttaattttggatgacatatggatgactgagccatagataaaatatttctggctgggtctagaaggcctaaa

SEQ ID NO: 1108 - DNA, 128 bp, Artificial
  Synthetic oligonucleotide
gctcatacatagaaagagatgtgactcccgccatcatggaggatgacgagttggccctagacttagaagacttgctgagcttttcttaccaggtggcaaagggcatggctttcctcgcctccaagaat

SEQ ID NO: 1109 - DNA, 123 bp, Artificial
  Synthetic oligonucleotide
tgtattcacagagacttggcagccagaaatatcctccttactcatggtcggatcacaaagatttgtgattttggtctagccagagacatcaagaatgattctaattatgtggttaaaggaaac

SEQ ID NO: 1110 - DNA, 1321 bp, Artificial
  Synthetic oligonucleotide
gtgagtacccattctctgcttgacagtcctgcaaaggatttttagtttcaactttcgataaaaattgtttcctgtgactttcataatgtaaatcctgtctagggatatcacacattttagcagtcaaattaagtatacttcagcaaaatttgcatggtatgctgaacattactacaactaacattcaataatagaagtcctaattctaattgtgtaattttggggcatgtgaaggaaacagaaatagccttaattttcattatagcctgagaatagcaatgaacttgattttgctcaagtgtaacaaatgtaggtcattgaaggtcacagcaggagaaattttggggggattggcatgccgtgtgaaaaatattaaaatctaagatcatattcagagttagccatatagaatgttggatcctagaatacacggagagctattaaataggttcataagtaataatgggtttgtagaacatagcaaatgtttttcaaagtgctgtatttccttgccaatttttattgaatcctcagaacaaacccttgtcctataattgcagcaccttcctattttaaaagttggagaaactaaggcatggcatattttagtgctttttatctgaggtgacacaggacaatagaggctgaaactagagcctgtgatttccagagtggcatcccatcgccatggaaaaccatattgccctttataatattctctgcctgtcttcctgggcccatttctgcagtccagatttattcctggaggtggatttttgtgccccttatgataatgtaatgttttccccccatcactgtggcgtctctattggtagcctgtactcgatttggttttgtaagagtgtttctgtgtttatctcctggccaaagcatgaatttctgaaaaggctgccctgaagctagatattatcatcaggagtgataataaaaacaacttctcttcatcctggtgcaattttggaaggaagaatgataagtcgttaattatccagtcctctgaatattgaccaaagggaggaggaagaaggtggccgcctccaggcccagtcttgatgaattctgcaatctgtctccattatttcatgcctgtgtaattttgtcaagagttgtccaatacctctgaatctttgtttttctccccttgggaataatagtgattcctgactcagaaagttatgagttaatatatgtaaagtgcttatgacagtgccagacatattgttactattctttatagatgtcttatttacgatctaaataatcgtgacggtggttacatactgtcttgttattggttagt

SEQ ID NO: 1111 - DNA, 194 bp, Artificial
  Synthetic oligonucleotide
aatgcacttgtgagccatgtatttcagaggtgattgggatcatctgagttcatataggtaaaaggtttttgtgagatggtactcaagttatcactccacatttcagcaacagcagcatctataagaatatcttctgttcaattttgttgagcttctgaattaacattattgactctgttgtgcttctattacag

SEQ ID NO: 1112 - DNA, 1494 bp, Artificial
  Synthetic oligonucleotide
gtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaat

SEQ ID NO: 1113 - DNA, 402 bp, Artificial
  Synthetic oligonucleotide
tttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctag

SEQ ID NO: 1114 - DNA, 282 bp, Artificial
  Synthetic oligonucleotide
atcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccag

SEQ ID NO: 1115 - DNA, 195 bp, Artificial
  Synthetic oligonucleotide
caataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaag

SEQ ID NO: 1116 - DNA, 137 bp, Artificial
  Synthetic oligonucleotide
ccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcag

SEQ ID NO: 1117 - DNA, 169 bp, Artificial
  Synthetic oligonucleotide
actaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtag

SEQ ID NO: 1118 - DNA, 116 bp, Artificial
  Synthetic oligonucleotide
atacgtaagtgaacttcatctaacgagattaaaaggcaccgaaggaggcacttacacattcctagtgtccaattctgacgtcaatgctgccatagcatttaatgtttatgtgaata

SEQ ID NO: 1119 - DNA, 115 bp, Artificial
  Synthetic oligonucleotide
caaaaccagaaatcctgacttacgacaggctcgtgaatggcatgctccaatgtgtggcagcaggattcccagagcccacaatagattggtatttttgtccaggaactgagcagag

SEQ ID NO: 1120 - DNA, 107 bp, Artificial
  Synthetic oligonucleotide
agcaaatccatccccacaccctgttcactcctttgctgattggtttcgtaatcgtagctggcatgatgtgcattattgtgatgattctgacctacaaatatttacag

SEQ ID NO: 1121 - DNA, 105 bp, Artificial
  Synthetic oligonucleotide
ggaaaaccctgggtgctggagctttcgggaaggttgttgaggcaactgcttatggcttaattaagtcagatgcggccatgactgtcgctgtaaagatgctcaagc

SEQ ID NO: 1122 - DNA, 111 bp, Artificial
  Synthetic oligonucleotide
cgagtgcccatttgacagaacgggaagccctcatgtctgaactcaaagtcctgagttaccttggtaatcacatgaatattgtgaatctacttggagcctgcaccattggag

SEQ ID NO: 1123 - DNA, 92 bp, Artificial
  Synthetic oligonucleotide
cagcgatagtactaatgagtacatggacatgaaacctggagtttcttatgttgtcccaaccaaggccgacaaaaggagatctgtgagaatag

SEQ ID NO: 1124 - DNA, 112 bp, Artificial
  Synthetic oligonucleotide
gctcgactacctgtgaagtggatggcacctgaaagcattttcaactgtgtatacacgtttgaaagtgacgtctggtcctatgggatttttctttgggagctgttctctttag

SEQ ID NO: 1125 - DNA, 100 bp, Artificial
  Synthetic oligonucleotide
gaagcagcccctatcctggaatgccggtcgattctaagttctacaagatgatcaaggaaggcttccggatgctcagccctgaacacgcacctgctgaaat

SEQ ID NO: 1126 - DNA, 106 bp, Artificial
  Synthetic oligonucleotide
gtatgacataatgaagacttgctgggatgcagatcccctaaaaagaccaacattcaagcaaattgttcagctaattgagaagcagatttcagagagcaccaatcat

SEQ ID NO: 1127 - DNA, 48 bp, Artificial
  Synthetic oligonucleotide
atttactccaacttagcaaactgcagccccaaccgacagaagcccgtg

SEQ ID NO: 1128 - DNA, 36 bp, Artificial
  Synthetic oligonucleotide
gtacttcaggggcacttcattgagagttttgtcttg

SEQ ID NO: 1129 - DNA, 113 bp, Artificial
  Synthetic oligonucleotide
gatattcttgaaagtttatatttttataattttttcttacatcagatgtttctttgcagtggcttaatgtttgaaattattttgtggctttttttgtaaatattgaaatgtag

SEQ ID NO: 1130 - DNA, 760 bp, Artificial; identical to SEQ ID NO: 335
  Synthetic oligonucleotide

SEQ ID NO: 1131 - DNA, 224 bp, Artificial; identical to SEQ ID NO: 336
  Synthetic oligonucleotide

SEQ ID NO: 1132 - DNA, 359 bp, Artificial; identical to SEQ ID NO: 337
  Synthetic oligonucleotide

SEQ ID NO: 1133 - DNA, 19 bp, Artificial
  Synthetic oligonucleotide
gtaggttcaaaaggcaaag

SEQ ID NO: 1134 - DNA, 14 bp, Artificial
  Synthetic oligonucleotide
actctctgctccag

SEQ ID NO: 1135 - DNA, 178 bp, Artificial; identical to SEQ ID NO: 340
  Synthetic oligonucleotide

SEQ ID NO: 1136 - DNA, 780 bp, Artificial; identical to SEQ ID NO: 341
  Synthetic oligonucleotide

SEQ ID NO: 1137 - DNA, 93 bp, Artificial; identical to SEQ ID NO: 342
  Synthetic oligonucleotide

SEQ ID NO: 1138 - DNA, 6 bp, Artificial
  Synthetic oligonucleotide
attcag

SEQ ID NO: 1139 - DNA, 56 bp, Artificial; identical to SEQ ID NO: 344
  Synthetic oligonucleotide

SEQ ID NO: 1140 - DNA, 115 bp, Artificial; identical to SEQ ID NO: 345
  Synthetic oligonucleotide

SEQ ID NO: 1141 - DNA, 34 bp, Artificial; identical to SEQ ID NO: 346
  Synthetic oligonucleotide

SEQ ID NO: 1142 - DNA, 26 bp, Artificial
  Synthetic oligonucleotide
ctttagcttggaagcaatgttgacaa

SEQ ID NO: 1143 - DNA, 8 bp, Artificial
  Synthetic oligonucleotide
tataccag

SEQ ID NO: 1144 - DNA, 42 bp, Artificial; identical to SEQ ID NO: 349
  Synthetic oligonucleotide

SEQ ID NO: 1145 - DNA, 245 bp, Artificial; identical to SEQ ID NO: 350
  Synthetic oligonucleotide

SEQ ID NO: 1146 - DNA, 161 bp, Artificial; identical to SEQ ID NO: 351
  Synthetic oligonucleotide

SEQ ID NO: 1147 - DNA, 121 bp, Artificial; identical to SEQ ID NO: 352
  Synthetic oligonucleotide

SEQ ID NO: 1148 - DNA, 631 bp, Artificial; identical to SEQ ID NO: 353
  Synthetic oligonucleotide

SEQ ID NO: 1149 - DNA, 150 bp, Artificial; identical to SEQ ID NO: 354
  Synthetic oligonucleotide

SEQ ID NO: 1150 - DNA, 233 bp, Artificial; identical to SEQ ID NO: 355
  Synthetic oligonucleotide

SEQ ID NO: 1151 - DNA, 76 bp, Artificial; identical to SEQ ID NO: 356
  Synthetic oligonucleotide

SEQ ID NO: 1152 - DNA, 119 bp, Artificial; identical to SEQ ID NO: 357
  Synthetic oligonucleotide

SEQ ID NO: 1153 - DNA, 59 bp, Artificial; identical to SEQ ID NO: 358
  Synthetic oligonucleotide

SEQ ID NO: 1154 - DNA, 40 bp, Artificial; identical to SEQ ID NO: 359
  Synthetic oligonucleotide

SEQ ID NO: 1155 - DNA, 51 bp, Artificial; identical to SEQ ID NO: 360
  Synthetic oligonucleotide

SEQ ID NO: 1156 - DNA, 84 bp, Artificial; identical to SEQ ID NO: 361
  Synthetic oligonucleotide

SEQ ID NO: 1157 - DNA, 573 bp, Artificial; identical to SEQ ID NO: 362
  Synthetic oligonucleotide

SEQ ID NO: 1158 - DNA, 387 bp, Artificial; identical to SEQ ID NO: 363
  Synthetic oligonucleotide

SEQ ID NO: 1159 - DNA, 249 bp, Artificial; identical to SEQ ID NO: 364
  Synthetic oligonucleotide

SEQ ID NO: 1160 - DNA, 10 bp, Artificial
  Synthetic oligonucleotide
gtgctggagc

SEQ ID NO: 1161 - DNA, 35 bp, Artificial; identical to SEQ ID NO: 366
  Synthetic oligonucleotide

SEQ ID NO: 1162 - DNA, 21 bp, Artificial
  Synthetic oligonucleotide
tgccacccggacaccaagaag

SEQ ID NO: 1163 - DNA, 92 bp, Artificial; identical to SEQ ID NO: 368
  Synthetic oligonucleotide

SEQ ID NO: 1164 - DNA, 60 bp, Artificial; identical to SEQ ID NO: 370
  Synthetic oligonucleotide

SEQ ID NO: 1165 - DNA, 71 bp, Artificial; identical to SEQ ID NO: 371
  Synthetic oligonucleotide

SEQ ID NO: 1166 - DNA, 70 bp, Artificial; identical to SEQ ID NO: 372
  Synthetic oligonucleotide

SEQ ID NO: 1167 - DNA, 11 bp, Artificial
  Synthetic oligonucleotide
ctcgcctcgca

SEQ ID NO: 1168 - DNA, 24 bp, Artificial
  Synthetic oligonucleotide
ctgctgcctgggctcggcgcgcgg

SEQ ID NO: 1169 - DNA, 7 bp, Artificial
  Synthetic oligonucleotide
gctcttc

SEQ ID NO: 1170 - DNA, 80 bp, Artificial; identical to SEQ ID NO: 376
  Synthetic oligonucleotide

SEQ ID NO: 1171 - DNA, 55 bp, Artificial; identical to SEQ ID NO: 377
  Synthetic oligonucleotide

SEQ ID NO: 1172 - DNA, 213 bp, Artificial; identical to SEQ ID NO: 378
  Synthetic oligonucleotide

SEQ ID NO: 1173 - DNA, 432 bp, Artificial; identical to SEQ ID NO: 379
  Synthetic oligonucleotide

SEQ ID NO: 1174 - DNA, 159 bp, Artificial; identical to SEQ ID NO: 380
  Synthetic oligonucleotide

SEQ ID NO: 1175 - DNA, 139 bp, Artificial; identical to SEQ ID NO: 381
  Synthetic oligonucleotide

SEQ ID NO: 1176 - DNA, 196 bp, Artificial; identical to SEQ ID NO: 382
  Synthetic oligonucleotide

SEQ ID NO: 1177 - DNA, 353 bp, Artificial; identical to SEQ ID NO: 383
  Synthetic oligonucleotide

SEQ ID NO: 1178 - DNA, 590 bp, Artificial; identical to SEQ ID NO: 384
  Synthetic oligonucleotide

SEQ ID NO: 1179 - DNA, 1228 bp, Artificial; identical to SEQ ID NO: 385
  Synthetic oligonucleotide

SEQ ID NO: 1180 - DNA, 326 bp, Artificial; identical to SEQ ID NO: 386
  Synthetic oligonucleotide

SEQ ID NO: 1181 - DNA, 70 bp, Artificial; identical to SEQ ID NO: 387
  Synthetic oligonucleotide

SEQ ID NO: 1182 - DNA, 39 bp, Artificial; identical to SEQ ID NO: 388
  Synthetic oligonucleotide

SEQ ID NO: 1183 - DNA, 79 bp, Artificial; identical to SEQ ID NO: 389
  Synthetic oligonucleotide

SEQ ID NO: 1184 - DNA, 34 bp, Artificial; identical to SEQ ID NO: 390
  Synthetic oligonucleotide

SEQ ID NO: 1185 - DNA, 33 bp, Artificial; identical to SEQ ID NO: 391
  Synthetic oligonucleotide

SEQ ID NO: 1186 - DNA, 39 bp, Artificial; identical to SEQ ID NO: 392
  Synthetic oligonucleotide

SEQ ID NO: 1187 - DNA, 21 bp, Artificial
  Synthetic oligonucleotide
gtggttctgatggctttgtaa

SEQ ID NO: 1188 - DNA, 48 bp, Artificial; identical to SEQ ID NO: 394
  Synthetic oligonucleotide

SEQ ID NO: 1189 - DNA, 38 bp, Artificial; identical to SEQ ID NO: 395
  Synthetic oligonucleotide

SEQ ID NO: 1190 - DNA, 111 bp, Artificial; identical to SEQ ID NO: 396
  Synthetic oligonucleotide

SEQ ID NO: 1191 - DNA, 13 bp, Artificial
  Synthetic oligonucleotide
ctgcgccttctac

SEQ ID NO: 1192 - DNA, 257 bp, Artificial; identical to SEQ ID NO: 398
  Synthetic oligonucleotide

SEQ ID NO: 1193 - DNA, 133 bp, Artificial; identical to SEQ ID NO: 399
  Synthetic oligonucleotide

SEQ ID NO: 1194 - DNA, 1786 bp, Artificial; identical to SEQ ID NO: 400
  Synthetic oligonucleotide

SEQ ID NO: 1195 - DNA, 153 bp, Artificial; identical to SEQ ID NO: 401
  Synthetic oligonucleotide

SEQ ID NO: 1196 - DNA, 110 bp, Artificial; identical to SEQ ID NO: 402
  Synthetic oligonucleotide

SEQ ID NO: 1197 - DNA, 84 bp, Artificial; identical to SEQ ID NO: 403
  Synthetic oligonucleotide

SEQ ID NO: 1198 - DNA, 23 bp, Artificial
  Synthetic oligonucleotide
gtatttatatattatatatttat

SEQ ID NO: 1199 - DNA, 139 bp, Artificial; identical to SEQ ID NO: 405
  Synthetic oligonucleotide

SEQ ID NO: 1200 - DNA, 135 bp, Artificial; identical to SEQ ID NO: 406
  Synthetic oligonucleotide

SEQ ID NO: 1201 - DNA, 163 bp, Artificial; identical to SEQ ID NO: 407
  Synthetic oligonucleotide

SEQ ID NO: 1202 - DNA, 215 bp, Artificial; identical to SEQ ID NO: 408
  Synthetic oligonucleotide

SEQ ID NO: 1203 - DNA, 173 bp, Artificial; identical to SEQ ID NO: 409
  Synthetic oligonucleotide

SEQ ID NO: 1204 - DNA, 1096 bp, Artificial; identical to SEQ ID NO: 410
  Synthetic oligonucleotide

SEQ ID NO: 1205 - DNA, 117 bp, Artificial; identical to SEQ ID NO: 411
  Synthetic oligonucleotide

SEQ ID NO: 1206 - DNA, 110 bp, Artificial; identical to SEQ ID NO: 412
  Synthetic oligonucleotide

SEQ ID NO: 1207 - DNA, 92 bp, Artificial; identical to SEQ ID NO: 413
  Synthetic oligonucleotide

SEQ ID NO: 1208 - DNA, 27 bp, Artificial
  Synthetic oligonucleotide
cagaaaattaatgaagtttcttcttct

SEQ ID NO: 1209 - DNA, 72 bp, Artificial; identical to SEQ ID NO: 415
  Synthetic oligonucleotide

SEQ ID NO: 1210 - DNA, 82 bp, Artificial; identical to SEQ ID NO: 416
  Synthetic oligonucleotide

SEQ ID NO: 1211 - DNA, 56 bp, Artificial; identical to SEQ ID NO: 417
  Synthetic oligonucleotide

SEQ ID NO: 1212 - DNA, 84 bp, Artificial; identical to SEQ ID NO: 418
  Synthetic oligonucleotide

SEQ ID NO: 1213 - DNA, 113 bp, Artificial; identical to SEQ ID NO: 419
  Synthetic oligonucleotide

SEQ ID NO: 1214 - DNA, 55 bp, Artificial; identical to SEQ ID NO: 420
  Synthetic oligonucleotide

SEQ ID NO: 1215 - DNA, 94 bp, Artificial; identical to SEQ ID NO: 421
  Synthetic oligonucleotide

SEQ ID NO: 1216 - DNA, 271 bp, Artificial; identical to SEQ ID NO: 422
  Synthetic oligonucleotide

SEQ ID NO: 1217 - DNA, 172 bp, Artificial; identical to SEQ ID NO: 423
  Synthetic oligonucleotide

SEQ ID NO: 1218 - DNA, 77 bp, Artificial; identical to SEQ ID NO: 424
  Synthetic oligonucleotide

SEQ ID NO: 1219 - DNA, 115 bp, Artificial; identical to SEQ ID NO: 425
  Synthetic oligonucleotide

SEQ ID NO: 1220 - DNA, 25 bp, Artificial
  Synthetic oligonucleotide
ctgtcccggaaggagaagctgagat

SEQ ID NO: 1221 - DNA, 62 bp, Artificial; identical to SEQ ID NO: 427
  Synthetic oligonucleotide

SEQ ID NO: 1222 - DNA, 108 bp, Artificial; identical to SEQ ID NO: 428
  Synthetic oligonucleotide

SEQ ID NO: 1223 - DNA, 48 bp, Artificial; identical to SEQ ID NO: 429
  Synthetic oligonucleotide

SEQ ID NO: 1224 - DNA, 9 bp, Artificial
  Synthetic oligonucleotide
atctggcag

SEQ ID NO: 1225 - DNA, 108 bp, Artificial; identical to SEQ ID NO: 431
  Synthetic oligonucleotide

SEQ ID NO: 1226 - DNA, 70 bp, Artificial; identical to SEQ ID NO: 432
  Synthetic oligonucleotide

SEQ ID NO: 1227 - DNA, 4 bp, Artificial
  Synthetic oligonucleotide
caag

SEQ ID NO: 1228 - DNA, 157 bp, Artificial; identical to SEQ ID NO: 434
  Synthetic oligonucleotide

SEQ ID NO: 1229 - DNA, 137 bp, Artificial; identical to SEQ ID NO: 435
  Synthetic oligonucleotide

SEQ ID NO: 1230 - DNA, 436 bp, Artificial; identical to SEQ ID NO: 436
  Synthetic oligonucleotide

SEQ ID NO: 1231 - DNA, 669 bp, Artificial; identical to SEQ ID NO: 437
  Synthetic oligonucleotide

SEQ ID NO: 1232 - DNA, 33 bp, Artificial; identical to SEQ ID NO: 438
  Synthetic oligonucleotide

SEQ ID NO: 1233 - DNA, 75 bp, Artificial; identical to SEQ ID NO: 439
  Synthetic oligonucleotide

SEQ ID NO: 1234 - DNA, 616 bp, Artificial; identical to SEQ ID NO: 440
  Synthetic oligonucleotide

SEQ ID NO: 1235 - DNA, 1062 bp, Artificial; identical to SEQ ID NO: 441
  Synthetic oligonucleotide

SEQ ID NO: 1236 - DNA, 261 bp, Artificial; identical to SEQ ID NO: 442
  Synthetic oligonucleotide

SEQ ID NO: 1237 - DNA, 1361 bp, Artificial; identical to SEQ ID NO: 443
  Synthetic oligonucleotide

SEQ ID NO: 1238 - DNA, 569 bp, Artificial; identical to SEQ ID NO: 444
  Synthetic oligonucleotide

SEQ ID NO: 1239 - DNA, 163 bp, Artificial; identical to SEQ ID NO: 445
  Synthetic oligonucleotide

SEQ ID NO: 1240 - DNA, 81 bp, Artificial; identical to SEQ ID NO: 446
  Synthetic oligonucleotide

SEQ ID NO: 1241 - DNA, 56 bp, Artificial; identical to SEQ ID NO: 447
  Synthetic oligonucleotide

SEQ ID NO: 1242 - DNA, 17 bp, Artificial
  Synthetic oligonucleotide
actctgtcaccctccag

SEQ ID NO: 1243 - DNA, 81 bp, Artificial; identical to SEQ ID NO: 449
  Synthetic oligonucleotide

SEQ ID NO: 1244 - DNA, 20 bp, Artificial
  Synthetic oligonucleotide
ttaaaaaaaaaaaaaaaaaa

SEQ ID NO: 1245 - DNA, 108 bp, Artificial; identical to SEQ ID NO: 451
  Synthetic oligonucleotide

SEQ ID NO: 1246 - DNA, 40 bp, Artificial; identical to SEQ ID NO: 452
  Synthetic oligonucleotide

SEQ ID NO: 1247 - DNA, 23 bp, Artificial
  Synthetic oligonucleotide
cttaggagaaaacttaaaaatat

SEQ ID NO: 1248 - DNA, 53 bp, Artificial; identical to SEQ ID NO: 454
  Synthetic oligonucleotide

SEQ ID NO: 1249 - DNA, 54 bp, Artificial; identical to SEQ ID NO: 455
  Synthetic oligonucleotide

SEQ ID NO: 1250 - DNA, 103 bp, Artificial; identical to SEQ ID NO: 456
  Synthetic oligonucleotide

SEQ ID NO: 1251 - DNA, 36 bp, Artificial; identical to SEQ ID NO: 457
  Synthetic oligonucleotide

SEQ ID NO: 1252 - DNA, 34 bp, Artificial; identical to SEQ ID NO: 458
  Synthetic oligonucleotide

SEQ ID NO: 1253 - DNA, 106 bp, Artificial; identical to SEQ ID NO: 459
  Synthetic oligonucleotide

SEQ ID NO: 1254 - DNA, 58 bp, Artificial; identical to SEQ ID NO: 460
  Synthetic oligonucleotide

SEQ ID NO: 1255 - DNA, 669 bp, Artificial; identical to SEQ ID NO: 461
  Synthetic oligonucleotide

SEQ ID NO: 1256 - DNA, 187 bp, Artificial; identical to SEQ ID NO: 462
  Synthetic oligonucleotide

SEQ ID NO: 1257 - DNA, 172 bp, Artificial; identical to SEQ ID NO: 463
  Synthetic oligonucleotide

SEQ ID NO: 1258 - DNA, 275 bp, Artificial; identical to SEQ ID NO: 464
  Synthetic oligonucleotide

SEQ ID NO: 1259 - DNA, 1685 bp, Artificial; identical to SEQ ID NO: 465
  Synthetic oligonucleotide

SEQ ID NO: 1260 - DNA, 877 bp, Artificial; identical to SEQ ID NO: 466
  Synthetic oligonucleotide

SEQ ID NO: 1261 - DNA, 252 bp, Artificial; identical to SEQ ID NO: 467
  Synthetic oligonucleotide

SEQ ID NO: 1262 - DNA, 349 bp, Artificial; identical to SEQ ID NO: 468
  Synthetic oligonucleotide

SEQ ID NO: 1263 - DNA, 233 bp, Artificial; identical to SEQ ID NO: 469
  Synthetic oligonucleotide

SEQ ID NO: 1264 - DNA, 51 bp, Artificial; identical to SEQ ID NO: 470
  Synthetic oligonucleotide

SEQ ID NO: 1265 - DNA, 75 bp, Artificial; identical to SEQ ID NO: 471
  Synthetic oligonucleotide

SEQ ID NO: 1266 - DNA, 83 bp, Artificial; identical to SEQ ID NO: 472
  Synthetic oligonucleotide

SEQ ID NO: 1267 - DNA, 103 bp, Artificial; identical to SEQ ID NO: 473
  Synthetic oligonucleotide

SEQ ID NO: 1268 - DNA, 95 bp, Artificial; identical to SEQ ID NO: 474
  Synthetic oligonucleotide

SEQ ID NO: 1269 - DNA, 38 bp, Artificial; identical to SEQ ID NO: 475
  Synthetic oligonucleotide

SEQ ID NO: 1270 - DNA, 75 bp, Artificial; identical to SEQ ID NO: 476
  Synthetic oligonucleotide

SEQ ID NO: 1271 - DNA, 19 bp, Artificial
  Synthetic oligonucleotide
cttactgaaggtacagccg

SEQ ID NO: 1272 - DNA, 65 bp, Artificial; identical to SEQ ID NO: 478
  Synthetic oligonucleotide

SEQ ID NO: 1273 - DNA, 107 bp, Artificial; identical to SEQ ID NO: 479
  Synthetic oligonucleotide

SEQ ID NO: 1274 - DNA, 100 bp, Artificial; identical to SEQ ID NO: 480
  Synthetic oligonucleotide

SEQ ID NO: 1275 - DNA, 48 bp, Artificial; identical to SEQ ID NO: 481
  Synthetic oligonucleotide

SEQ ID NO: 1276 - DNA, 126 bp, Artificial
  Synthetic oligonucleotide
gtgctcacctccacagcggcttccttgatccttgccacccgcgactgaacaccgacagcagcagcctcaccatgaagttgctgatggtcctcatgctggcggccctctcccagcactgctacgcag

SEQ ID NO: 1277 - DNA, 179 bp, Artificial
  Synthetic oligonucleotide
gctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgag

SEQ ID NO: 1278 - DNA, 593 bp, Artificial
  Synthetic oligonucleotide
gtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 1279 - DNA, 211 bp, Artificial
  Synthetic oligonucleotide
caattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 1280 - DNA, 9 bp, Artificial
  Synthetic oligonucleotide
gtgtttatg

SEQ ID NO: 1281 - protein, 152 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVGDCGFPAFRELKRAETVSPVFFTRRCIWEDLKSTGFSPAGGGRPPGGGPRTQEDSGLPCWRSSCSVTLQV

SEQ ID NO: 1282 - protein, 83 aa, Homo sapiens
MVWCLGLAVLSLVISQGADGRGKPEVVSVVGRAGESVVLGCDLLPPAGRPPLHVIEWLRFGFLLPIFIQFGLYSPRIDPDYVG

SEQ ID NO: 1283 - protein, 496 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKVPIGWVLSPSPTSLRAPLPG

SEQ ID NO: 1284 - protein, 301 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRERQDLTMLSRLVLNSWPQMILPPQPPKVLEL

SEQ ID NO: 1285 - protein, 283 aa, Homo sapiens [sequence omitted]

SEQ ID NO: 1286 - protein, 447 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 1287 - protein, 363 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSDKYYRVNLRTRRVDTVDPPYPRSIAQYWLGCPAPGHL

SEQ ID NO: 1288 - protein, 238 aa, Homo sapiens [sequence omitted]

SEQ ID NO: 1289 - protein, 790 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNPHKYSAHGRTRHFESATRTTNGAQKLSRI

SEQ ID NO: 1290 - protein, 791 aa, Homo sapiens
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1291 - protein, 416 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERG

SEQ ID NO: 1292 - protein, 410 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRCVIVPPLSQPQIH

SEQ ID NO: 1293 - protein, 210 aa, Homo sapiens [sequence omitted]

SEQ ID NO: 1294 - protein, 145 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTGLLHRLNH

SEQ ID NO: 1295 - DNA, 21 bp, Artificial
  Synthetic oligonucleotide
tgacactggcaaaacaatgca

SEQ ID NO: 1296 - DNA, 21 bp, Artificial
  Synthetic oligonucleotide
ggtccttttcaccagcaagct

SEQ ID NO: 1297 - DNA, 94 bp, Artificial
  Synthetic oligonucleotide
tgacactggcaaaacaatgcagactttgctttccttggtcaggcagtataatccaaagatggtcaaggtcgcaagcttgctggtgaaaaggacc

SEQ ID NO: 1298 - DNA, 23 bp, Artificial
  Synthetic oligonucleotide
tggcaagaagaaggtctggttag

SEQ ID NO: 1299 - protein, 141 aa, Homo sapiens [sequence omitted]

SEQ ID NO: 1300 - protein, 142 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 1301 - protein, 201 aa, Homo sapiens
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWEARWLTPVIPALWEAETGGSRGQEMETIPANTLIQEDILDTGNDKNGKEEVIKRKIPYILKRQLYENKPRRPYILKRDSYYY

SEQ ID NO: 1302 - protein, 168 aa, Homo sapiens
MMAGMKIQLVCMLLLAFSSWSLCSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 1303 - protein, 95 aa, Homo sapiens
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 1304 - protein, 33 aa, Homo sapiens
MKLVSVALMYLGSLAFLGADTARLDVASEFRKK

SEQ ID NO: 1305 - protein, 83 aa, Homo sapiens
MKLVSVALMYLGSLAFLGADTARLDVASEFRKKWNKWALSRGKRELRMSSSYPTGLADVKAGPAQTLIRPQDMKGASRSPEDR

SEQ ID NO: 1306 - protein, 180 aa, Homo sapiens [sequence omitted]

SEQ ID NO: 1307 - protein, 381 aa, Homo sapiens [sequence omitted]

SEQ ID NO: 1308 - protein, 385 aa, Homo sapiens [sequence omitted]

SEQ ID NO: 1309 - protein, 81 aa, Homo sapiens
MSLLSSRAARVPGPSSSLCALLVLLLLLTQPGPIASAGPAAAVLRELRCVCLQTTQGVHPKMISNLQVFAIGPQCSKVEVV

SEQ ID NO: 1310 - protein, 340 aa, Homo sapiens
MKSLTATSSMKVLLPRTFWTRKLMKFLLLLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1311 - protein, 238 aa, Homo sapiens
MAEKALLCPSSAGLGTWPWVLNSAWPVLPLAVDQGVDWRPRGPVSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 1312 - protein, 80 aa, Homo sapiens
MRILQLILLALATGLVGGETRIIKGFECKPHSQPWQAALFEKTRLLCGATLIAPRWLLTAAHCLKPTPASHLAMRQHHHH

SEQ ID NO: 1313 - protein, 123 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRYAPPLLTFLPTRPSCGSQDGKGPPHQVI

SEQ ID NO: 1314 - protein, 464 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQDAMVVSSRPKATTHRKSRTLSRR

SEQ ID NO: 1315 - protein, 434 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHRSKRNL

SEQ ID NO: 1316 - protein, 454 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQLLWLRGKVSFYCF

SEQ ID NO: 1317 - protein, 429 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 1318 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 1319 - protein, 326 aa, Homo sapiens
HTREGTLGGQKRAFPDGVEGEKGRGRAWGAASRGSAVPLTIRGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 1320 - protein, 213 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHG

SEQ ID NO: 1321 - protein, 307 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGCCLSPSHYRPHSTAISPHPPGSSGRHHKQLYVQPPLPQVQFPQGHLWRHGLCWQCPRREGCLLRECPCHHSQPRKASCVPVPYLTLMPTPGGGDCCPTLQMQKRRLGCCQGEEEDVHPVYPAP

SEQ ID NO: 1322 - protein, 265 aa, Homo sapiens
HTREGTLGGQKRAFPDGVEGEKGRGRAWGAASRGSAVPLTIRGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFVSVPATTPSPGKHPVSLCLI

SEQ ID NO: 1323 - protein, 188 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEDKRTQ

SEQ ID NO: 1324 - protein, 354 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITGEGHSLPISPGVLQTQNCGP

SEQ ID NO: 1325 - protein, 352 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 1326 - protein, 363 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVENSPTPRLLPNMGGAPGRCPRPSLGAWRGASCWC

SEQ ID NO: 1327 - protein, 398 aa, Homo sapiens
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 1328 - protein, 432 aa, Homo sapiens [sequence omitted]

SEQ ID NO: 1329 - protein, 52 aa, Homo sapiens
MALFGALFLALLAGAHAEFPGRGCAFWSKSWRLSPFRTCGAKKATSTTTSLR

SEQ ID NO: 1330 - protein, 98 aa, Homo sapiens
MALFGALFLALLAGAHAEFPGCKIRVTSKALELVKQEGLRFLEQELETITIPDLRGKEGHFYYNISEPGLERGADKFPVVGGSSLFLALDLTLRPPVG

SEQ ID NO: 1331 - protein, 200 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQVWAATGRRVARVGMLSL

SEQ ID NO: 1332 - protein, 217 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVLWTSLLALTIPS

SEQ ID NO: 1333 - protein, 148 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQVWAATGRRVARVGMLSL

SEQ ID NO: 1334 - protein, 258 aa, Homo sapiens
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 1335 - protein, 140 aa, Homo sapiens [sequence omitted]

SEQ ID NO: 1336 - protein, 919 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1337 - protein, 907 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1338 - protein, 212 aa, Homo sapiens
PELRQPARLGLPECWDYRHEPRCPAQMGSHFIVQAGLKLLASSKPPKCWDYRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1339 - protein, 812 aa, Homo sapiens
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKVRKSW

SEQ ID NO: 1340 - protein, 107 aa, Homo sapiens
MGKRRHRPRVSLAVCGPPLATLSWLAGCRSASFSGWPACCSGLGCLTITPSQGSAGHCERWLPGQCSSVWTVPQARAHQLGSCPEGWDLSGSCAGQSGELLVCGGKL

SEQ ID NO: 1341 - protein, 725 aa, Homo sapiens
MATYIHVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1342 - protein, 674 aa, Homo sapiens
MTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1343 - protein, 593 aa, Homo sapiens
MELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1344 - protein, 239 aa, Homo sapiens [sequence omitted]

SEQ ID NO: 1345 - protein, 737 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRE

SEQ ID NO: 1346 - protein, 514 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDEVKNAIYFFFHKVLLLLFVVDVCSRNLIGIEAFHNYRIMWKFLGRCPFTASYKLIITEFRK

SEQ ID NO: 1347 - protein, 125 aa, Homo sapiens
MTQNFRLMWNILLFPLNFSLNQKLQLEQEKLSSDYNKLKIEDQEREMKLEKLLLLNDKREQAREDLKGLEETVSRELQTLHNLRKLFVQDLTTRVKKVSSLCLNGTEKKIKDGREESFSVEISLA

SEQ ID NO: 1348 - protein, 385 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNDFLAAHVFGKLLE

SEQ ID NO: 1349 - protein, 324 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRV

SEQ ID NO: 1350 - protein, 519 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGE

SEQ ID NO: 1351 - protein, 541 aa, Homo sapiens [sequence omitted]

SEQ ID NO: 1352 - protein, 544 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGECVCSKGFPFPLIGDSEG

SEQ ID NO: 1353 - protein, 619 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELVRGGTAGYLGEETRGQRPGCDSQSHTGPSKKPSAPSPLPAGTSWDRGVP

SEQ ID NO: 1354 - protein, 597 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 1355 - protein, 498 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIRECLLPWLPLQISEGRS

SEQ ID NO: 1356 - protein, 588 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVLTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 1357 - protein, 505 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQPQNPNSQPRAAGSLEVIISHPFVRRLEILISPFQFQNSIPKNSQIVPAASPRGTSSP

SEQ ID NO: 1358 - protein, 62 aa, Homo sapiens
MPASARLAGAGLLLAFLRALGCAGRAPGLSMAEGNTLISVDYEIFGKVQGVFFRKHTQLFTI

SEQ ID NO: 1359 - protein, 64 aa, Homo sapiens
SGRGGLRALVSRWRGGPGVILAAGGEDKEGLSMAEGNTLISVDYEIFGKVQGVFFRKHTQLFTI

SEQ ID NO: 1360 - protein, 129 aa, Homo sapiens
MPASARLAGAGLLLAFLRALGCAGRAPGLSMAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1361 - protein, 73 aa, Homo sapiens
MQAEGKKLGLVGWVQNTDRGTVQGQLQGPISKVRHMQEWLETRGSPKSHIDKANFNNEKVILKLDYSDFQIVK

SEQ ID NO: 1362 - protein, 87 aa, Homo sapiens
SGRGGLRALVSRWRGGPGVILAAGGEDKEGLSMAEGNTLISVDYEIFGKVQGVFFRKHTQEMTVENRIAETHSKSCVPVSFATSYAG

SEQ ID NO: 1363 - protein, 80 aa, Homo sapiens
SGRGGLRALVSRWRGGPGVILAAGGEDKEGLSMAEGNTLISVDYEIFGKVQGVFFRKHTQLCFWEAEEGGSFEPGRLRLQ

SEQ ID NO: 1364 - protein, 94 aa, Homo sapiens
SGRGGLRALVSRWRGGPGVILAAGGEDKEGLSMAEGNTLISVDYEIFGKVQGVFFRKHTQEMTVENRIAETHSKSCVPVSFATSYAGINEFKRI

SEQ ID NO: 1365 - protein, 69 aa, Homo sapiens
SGRGGLRALVSRWRGGPGVILAAGGEDKEGLSMAEGNTLISVDYEIFGKVQGVFFRKHTQVCGLQALGW

SEQ ID NO: 1366 - protein, 85 aa, Homo sapiens
MPASARLAGAGLLLAFLRALGCAGRAPGLSMAEGNTLISVDYEIFGKVQGVFFRKHTQEMTVENRIAETHSKSCVPVSFATSYAG

SEQ ID NO: 1367 - protein, 78 aa, Homo sapiens
MPASARLAGAGLLLAFLRALGCAGRAPGLSMAEGNTLISVDYEIFGKVQGVFFRKHTQLCFWEAEEGGSFEPGRLRLQ

SEQ ID NO: 1368 - protein, 92 aa, Homo sapiens
MPASARLAGAGLLLAFLRALGCAGRAPGLSMAEGNTLISVDYEIFGKVQGVFFRKHTQEMTVENRIAETHSKSCVPVSFATSYAGINEFKRI

SEQ ID NO: 1369 - protein, 67 aa, Homo sapiens
MPASARLAGAGLLLAFLRALGCAGRAPGLSMAEGNTLISVDYEIFGKVQGVFFRKHTQVCGLQALGW

SEQ ID NO: 1370 - protein, 1305 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1371 - protein, 246 aa, Homo sapiens
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMEVGLGRGLGDSEWVRGCVCHHAQHREILDGNRVASAVEDEGAEVDGEAFRWGSLWVGESWDM

SEQ ID NO: 1372 - protein, 1081 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVVSMMIINSQTIMVVNYSSSFITLML

SEQ ID NO: 1373 - protein, 729 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKMCCNLSFGILIPLQK

SEQ ID NO: 1374 - protein, 738 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGMAGVDGPPGPKGNMGPQGEPGPPGQQGNPGPQGLPGPQGPIGPPGEKVSFSFSLFYKKVIKFACDKRFVGRHDERKVVKLSLPLYLIYE

SEQ ID NO: 1375 - protein, 273 aa, Homo sapiens [sequence omitted]

SEQ ID NO: 1376 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1377 - protein, 99 aa, Homo sapiens
MKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1378 - protein, 135 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKG

SEQ ID NO: 1379 - protein, 154 aa, Homo sapiens; identical to SEQ ID NO: 1376

SEQ ID NO: 1380 - protein, 315 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLCEYICSSLAQAASPNPQGQRQDFSVPLRFKYTDPQPWTSRLSVTFCPRKTWADQVLTKNRRGGAASVLGGSGSTPYDGRNR

SEQ ID NO: 1381 - protein, 719 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSGKWLPGASASYSGVESIWFSPKSQEDIFFPSLCSMGTRKSQILS

SEQ ID NO: 1382 - protein, 569 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSNPVEDKDAVAFTCEPEVQNTTYLWWVNGQSLPVSPRLQLSNGNMTLTLLSCQKERCRIL

SEQ ID NO: 1383 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1384 - protein, 346 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1385 - protein, 385 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCALPGVPGQRVRRGFAVPLIQEGAHGDGAALRRAAGACLLPLHLQGLHGRVRAYEAGGGSRAMARPSSPDGPPPPPHLTWPCAGAGSAAAMWRW

SEQ ID NO: 1386 - protein, 346 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECVRTRRVGARGPWPGPPRPMGHPLLRT

SEQ ID NO: 1387 - protein, 271 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARSGFGQREGTYHFRMTILPPLEKLRLLLEKLSRFHAKFTLEYS

SEQ ID NO: 1388 - protein, 399 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVRGAGEREAGQQSAPVTPCALPGVPGQRVRRGFAVPLIQEGAHGDGAALRRAAGACLLPLHLQGLHGRVRVPRRLCGGGEHGRCSAAADAEADECAAVPAGARTGPAGPGGQPARAHRPLLCAVPG

SEQ ID NO: 1389 - protein, 555 aa, Homo sapiens [sequence omitted]

SEQ ID NO: 1390 - protein, 139 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGKQGMRAH

SEQ ID NO: 1391 - protein, 156 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKGEKRHHKQLRDQEVDPLEMRRHSAG

SEQ ID NO: 1392 - protein, 89 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPRGSLGSAQ

SEQ ID NO: 1393 - protein, 82 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPT

SEQ ID NO: 1394 - protein, 496 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGALGVRQLVGGGHSSRFSHLVVAGLPHACHRKSGSSSQVLCPEPSALLSVAG

SEQ ID NO: 1395 - protein, 382 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 1396 - protein, 370 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 1397 - protein, 301 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPVPLLLCWPL

SEQ ID NO: 1398 - protein, 354 aa, Homo sapiens [sequence omitted]

SEQ ID NO: 1399 - protein, 137 aa, Homo sapiens
MAARALCMLGLVLALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 1400 - protein, 41 aa, Homo sapiens [sequence omitted]

SEQ ID NO: 1401 - protein, 159 aa, Homo sapiens
MHTVVSWSDDMFLPILIVFLSTWTHSSLAQGWVISTPCCCCSDLHPGPAWSHSENALLSHGQALRALPAWPSQRRPESLGPKQRGRTGLRVLAPCSLHTWGSTLAFPGSLCDFRAGPLGPLGLIIFICNRAMPLPCLVVLRSSCLCKQLVQCQHEMGGP

SEQ ID NO: 1402 - protein, 187 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHECYKIEITMPKRRKVKLRD

SEQ ID NO: 1403 - protein, 449 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATLASFSHMSDQRSARPQAGQPHGVVLPGRDCEIPLPPV

SEQ ID NO: 1404 - protein, 341 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQNLLKAQCTSTVPRGIPPS

SEQ ID NO: 1405 - protein, 287 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEPHWRH

SEQ ID NO: 1406 - protein, 433 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATKRSRSVAQAGVQWCDHDSPQP

SEQ ID NO: 1407 - protein, 418 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIREYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 1408 - protein, 60 aa, Homo sapiens
MPFRLLIPLGLLCALLPQHHGAPGPDGSAPDPAHYRFWGMSQNSKEWLKCSRTAWTLILM

SEQ ID NO: 1409 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1410 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1411 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 1412 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 1413 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 1414 - protein, 111 aa, Homo sapiens
MQSVQSTSFCLRKQCLCLTFLLLHLLGQVAATQRCPPQCPGQCPATPPTCAPGVRAVLDGCSCCLVCARQRGESCSDLEPCDESSGLYCDRSADPSNQTGICTGNPAPSAV

SEQ ID NO: 1415 - protein, 90 aa, Homo sapiens
MKLLMVLMLAALSQHCYAGSGCPLLENVISKTINPQVSKTEYKELLQEFIDDNATTNAIDELKECFLNQTDETLSNVEQLIYDSSLCDLF

SEQ ID NO: 1416 - protein, 93 aa, Homo sapiens
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 1417 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRLGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 1418 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 1419 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1420 - DNA, 22 bp, Artificial
  Synthetic oligonucleotide
tgatcagcccatctttgatgag

SEQ ID NO: 1421 - protein, 148 aa, Homo sapiens
MRGSELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 1422 - protein, 170 aa, Artificial
  Synthetic peptide
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 1423 - protein, 185 aa, Homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 1424 - protein, 328 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 1425 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 1426 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1427 - protein, 214 aa, Homo sapiens
MGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVVEELLSGNPHIEKESARSIADGAMMEAASVCMGQMEPDQVYEGITFEDFLKIWQGIDIETKMHVRFLNMETMALCH

SEQ ID NO: 1428 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 1429 - protein, 99 aa, Homo sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 1430 - protein, 446 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 1431 - protein, 314 aa, Homo sapiens; identical to SEQ ID NO: 1318

SEQ ID NO: 1432 - protein, 517 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 1433 - protein, 493 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 1434 - protein, 258 aa, Homo sapiens; identical to SEQ ID NO: 1334

SEQ ID NO: 1435 - protein, 199 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNKGASQAGMTGYGMPRQIM

SEQ ID NO: 1436 - protein, 919 aa, Homo sapiens; identical to SEQ ID NO: 1336

SEQ ID NO: 1437 - protein, 931 aa, Homo sapiens
PDVIWGAGCRGLMTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1438 - protein, 957 aa, Homo sapiens
MADPAECSIKVMCRFRPLNEAEILRGDKFIPKFKGDETVVIGQGKPYVFDRVLPPNTTQEQVYNACAKQIVKDVLEGYNGTIFAYGQTSSGKTHTMEGKLHDPQLMGIIPRIAHDIFDHIYSMDENLEFHIKVSYFEIYLDKIRDLLDVSKTNLAVHEDKNRVPYVKGCTERFVSSPEEVMDVIDEGKANRHVAVTNMNEHSSRSHSIFLINIKQENVETEKKLSGKLYLVDLAGSEKVSKTGAEGAVLDEAKNINKSLSALGNVISALAEGTKTHVPYRDSKMTRILQDSLGGNCRTTIVICCSPSVFNEAETKSTLMFGQRAKTIKNTVSVNLELTAEEWKKKYEKEKEKNKTLKNVIQHLEMELNRWRNGEAVPEDEQISAKDQKNLEPCDNTPIIDNIAPVVAGISTEEKEKYDEEISSLYRQLDDKDDEINQQSQLAEKLKQQMLDQDELLASTRRDYEKIQEELTRLQIENEAAKDEVKEVLQALEELAVNYDQKSQEVEDKTRANEQLTDELAQKTTTLTTTQRELSQLQELSNHQKKRATEILNLLLKDLGEIGGIIGTNDVKTLADVNGVIEEEFTMARLYISKMKSEVKSLVNRSKQLESAQMDSNRKMNASERELAACQLLISQHEAKIKSLTDYMQNMEQKRRQLEESQDSLSEELAKLRAQEKMHEVSFQDKEKEHLTRLQDAEEMKKALEQQMESHREAHQKQLSRLRDEIEEKQKIIDEIRDLNQKLQLEQEKLSSDYNKLKIEDQEREMKLEKLLLLNDKREQAREDLKGLEETVSRELQTLHNLRKLFVQDLTTRVKKSVELDNDDGGGSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1439 - protein, 650 aa, Homo sapiens
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 1440 - protein, 98 aa, Homo sapiens
AEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1441 - protein, 99 aa, Homo sapiens
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 1442 - protein, 246 aa, Homo sapiens; identical to SEQ ID NO: 1371

SEQ ID NO: 1443 - protein, 862 aa, Homo sapiens
HDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGLTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1444 - protein, 295 aa, Homo sapiens
LRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1445 - protein, 1007 aa, Homo sapiens
MLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSPPSTLLGALHRLSPSTST

SEQ ID NO: 1446 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGYPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 1447 - protein, 1806 aa, Homo sapiens
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLRGRPGPQGPPGPAGEKGAPGEKGPQGPAGRDGVQGPVGLPGPAGPAGSPGEDGDKGEIGEPGQKGSKGGKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGELGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGPPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCTSRKGYEKTVIEINTPKIDQVPIVDVMISDFGDQNQKFGFEVGPVCFLG

SEQ ID NO: 1448 - protein, 153 aa, Homo sapiens
GLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 1449 - protein, 154 aa, Homo sapiens; identical to SEQ ID NO: 1376

SEQ ID NO: 1450 - protein, 99 aa, Homo sapiens; identical to SEQ ID NO: 1377

SEQ ID NO: 1451 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 1452 - protein, 495 aa, Homo sapiens [sequence omitted]

SEQ ID NO: 1453 - protein, 496 aa, Homo sapiens
MASSTGDRSQAVRHGLRAKVLTLDGMNPRVRRVEYAVRGPIVQRALELEQELRQGVKKPFTEVIRANIGDAQAMGQRPITFLRQVLALCVNPDLLSSPNFPDDAKKRAERILQACGGHSLGAYSVSSGIQLIREDVARYIERRDGGIPADPNNVFLSTGASDAIVTVLKLLVAGEGHTRTGVLIPIPQYPLYSATLAELGAVQVDYYLDEERAWALDVAELHRALGQARDHCRPRALCVINPGNPTGQVQTRECIEAVIRFAFEERLFLLADEVYQDNVYAAGSQFHSFKKVLMEMGPPYAGQQELASFHSTSKGYMGECGFRGGYVEVVNMDAAVQQQMLKLMSVRLCPPVPGQALLDLVVSPPAPTDPSFAQFQAEKQAVLAELAAKAKLTEQVFNEAPGISCNPVQGAMYSFPRVQLPPRAVERAQELGLAPDMFFCLRLLEETGICVVPGSGFGQREGTYHFRMTILPPLEKLRLLLEKLSRFHAKFTLEYS

SEQ ID NO: 1454 - protein, 132 aa, Homo sapiens
MKSSGLFPFLVLLALGTLAPWAVEGSGKSFKAGVCPPKKSAQCLRYKKPECQSDWQCPGKKRCCPDTCGIKCLDPVDTPNPTRRKPGKCPVTYGQCLMLNPPNFCEMDGQCKRDLKCCMGMCGKSCVSPVKA

SEQ ID NO: 1455 - protein, 488 aa, Homo sapiens [sequence omitted]

SEQ ID NO: 1456 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 1457 - protein, 95 aa, Homo sapiens
MTELETAMGMIIDVFSRYSGSEGSTQTLTKGELKVLMEKELPGFLQSGKDKDAVDKLLKDLDANGDAQVDFSEFIVFVAAITSACHKYFEKAGLK

SEQ ID NO: 1458 - protein, 302 aa, Homo sapiens
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 1459 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 1460 - protein, 578 aa, Homo sapiens [sequence omitted]

SEQ ID NO: 1461 - protein, 541 aa, Homo sapiens [sequence omitted]

SEQ ID NO: 1462 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 1463 - protein, 357 aa, Homo sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 1464 - DNA, 516 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgagcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggcaaaaaaaaaaat

SEQ ID NO: 1465 - DNA, 907 bp, Homo sapiens
gtgctcacctccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattt

SEQ ID NO: 1466 - DNA, 21 bp, Homo sapiens
tgacactggcaaaacaatgca

SEQ ID NO: 1467 - DNA, 21 bp, Homo sapiens
ggtccttttcaccagcaagct

SEQ ID NO: 1468 - DNA, 94 bp, Artificial; identical to SEQ ID NO: 1297
  Synthetic oligonucleotide

SEQ ID NO: 1469 - DNA, 19 bp, Homo sapiens
tgagagtgattcgcgtggg

SEQ ID NO: 1470 - DNA, 21 bp, Homo sapiens
ccagggtacgaggctttcaat

SEQ ID NO: 1471 - DNA, 91 bp, Artificial; identical to SEQ ID NO: 334
  Synthetic oligonucleotide

SEQ ID NO: 1472 - DNA, 19 bp, Homo sapiens
atttgggtcgcggttcttg

SEQ ID NO: 1473 - DNA, 21 bp, Homo sapiens
tgccttgacattctcgatggt

SEQ ID NO: 1474 - DNA, 133 bp, Artificial; identical to SEQ ID NO: 328
  Synthetic oligonucleotide

SEQ ID NO: 1475 - DNA, 20 bp, Homo sapiens
tgggaacaagagggcatctg

SEQ ID NO: 1476 - DNA, 22 bp, Homo sapiens
ccaccactgcatcaaattcatg

SEQ ID NO: 1477 - DNA, 86 bp, Artificial; identical to SEQ ID NO: 331
  Synthetic oligonucleotide

SEQ ID NO: 1478 - DNA, 19 bp, Artificial
  Synthetic oligonucleotide
agactccaacccacagccc

SEQ ID NO: 1479 - DNA, 19 bp, Artificial
  Synthetic oligonucleotide
cagctcagccaaccttgca

SEQ ID NO: 1480 - DNA, 138 bp, Artificial
  Synthetic oligonucleotide
agactccaacccacagcccagctgtggctgcacagtgagcctgatgggaggtggggaacagggacagggggccacctgggcttcttcacagagaggtcagcaggaaggcttggctacagtgcaaggttggctgagctg

SEQ ID NO: 1481 - DNA, 1491 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1482 - DNA, 1644 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaagtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacagcgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1483 - DNA, 1404 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacaggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1484 - DNA, 2797 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1485 - DNA, 2962 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1486 - DNA, 2605 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacagaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1487 - DNA, 2254 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1488 - DNA, 2611 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1489 - DNA, 2446 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1490 - DNA, 844 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaagggtaagaggggcctaatgggggaagacagtagtcacaccagtaatgcaccccaacactaaacctcacctttttgtccccgctccctcccctagagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1491 - DNA, 752 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattggtggggatcagtcagcctcggaaccccttggaagagctcaggcctagccctaggggtcaaaatgtggggcctgggccccctgcccagacaggtacctgttggagccatggtaacacggcctccatggctgagtaggggactaggaagggtaaaagtggggttttggggttttgcactcactcctgctgtctcctacttactgtgatagtcctggtcccagctcctggaaagctctttgctcttagaagatctccctttcctccagcaaaatgtcatctcgccaggtgccatggcttgtacctgtaatcacagctactcaggaggctgaagcaggaggatcactggaggccaggagttggagaccagcctggatgacagagggagatcccatctctttaaaaaataaataaataaataaataataaatatc

SEQ ID NO: 1492 - protein, 314 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 1493 - protein, 285 aa, Homo sapiens
MVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 1494 - protein, 868 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 1495 - protein, 901 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1496 - protein, 782 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1497 - protein, 665 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1498 - protein, 784 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALVRLQPTAQLWLHSEPDGRWGTGTGGHLGFFTERSAGRLGYSARLAEL

SEQ ID NO: 1499 - protein, 751 aa, Homo sapiens
MTTRQATKDPLLRGVSPTPSKIPVRSQKRTPFPTVTSCAVDQENQDPRGVRASAYLAPRTPTHRLDPARASCFSRLEGPGPRGRTLCPQRLQALISPSGPSFHPSTRPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGKELAGKECEHKRSSPHCELHTCPAPTPGNLMLPHLPPWPSLALPQEEGRGCTSSPVLLIGLAVGGGGGEDSTWWKYRTPDLPLNFPCPSGLSNLAPRTLALRERLKSCLTAIHCFHEARLDDECAFYTSRAPPSGPTRVCTNPVATLLEWQDALCFIPVGSAAPQGSP

SEQ ID NO: 1500 - protein, 52 aa, Homo sapiens
MTTRQATKDPLLRGVSPTPSKIPVRSQKRTPFPTVTSCAVDQENQDPRVRGA

SEQ ID NO: 1501 - protein, 126 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTGTCWSHGNTASMAE

SEQ ID NO: 1502 - DNA, 92 bp, Artificial
  Synthetic oligonucleotide
gtaagaggggcctaatgggggaagacagtagtcacaccagtaatgcaccccaacactaaacctcacctttttgtccccgctccctcccctag

SEQ ID NO: 1503 - DNA, 111 bp, Artificial
  Synthetic oligonucleotide
gtacctgttggagccatggtaacacggcctccatggctgagtaggggactaggaagggtaaaagtggggttttggggttttgcactcactcctgctgtctcctacttactg

SEQ ID NO: 1504 - DNA, 204 bp, Artificial
  Synthetic oligonucleotide
ctgtctccactaaaattttaaaaattagaaagtgctctctggaaaagctgcctaactctcactgcttctctgctgcccctcctaatgtacatctagggcctctcagttaggggcttcaatccattcctcatgagggtgggactcaggctggtctttctcctgccccagcctggcttgcttgtgtgccttgttccttggtgacag

SEQ ID NO: 1505 - DNA, 153 bp, Artificial
  Synthetic oligonucleotide
gtgagtctgtgtggccaacagctttgatgtctattgaacagtgactgggctgaggaagagggaaaagagatgggggatcaggaataggacagtgtgggtagactactgaacgcacatcttgatgtcacactggggtgctctctcccaccacag

SEQ ID NO: 1506 - DNA, 270 bp, Artificial
  Synthetic oligonucleotide
gtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcag

SEQ ID NO: 1507 - DNA, 165 bp, Artificial
  Synthetic oligonucleotide
gtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccag

SEQ ID NO: 1508 - protein, 90 aa, Artificial
  Synthetic peptide
GKELAGKECEHKRSSPHCELHTCPAPTPGNLMLPHLPPWPSLALPQEEGRGCTSSPVLLIGLAVGGGGGEDSTWWKYRTPDLPLNFPCPS

SEQ ID NO: 1509 - protein, 47 aa, Artificial
  Synthetic peptide
VRLQPTAQLWLHSEPDGRWGTGTGGHLGFFTERSAGRLGYSARLAEL

SEQ ID NO: 1510 - protein, 14 aa, Artificial
  Synthetic peptide
GTCWSHGNTASMAE

SEQ ID NO: 1511 - protein, 4 aa, Artificial
  Synthetic peptide
VRGA

SEQ ID NO: 1512 - DNA, 50 bp, Homo sapiens
catggtaacacggcctccatggctgagtaggggactaggaagggtaaaag

SEQ ID NO: 1513 - DNA, 50 bp, Homo sapiens
tgtacatctagggcctctcagttaggggcttcaatccattcctcatgagg

SEQ ID NO: 1514 - DNA, 50 bp, Homo sapiens
tgtgaacacaagaggtcctcacctcactgtgagctgcacacctgccctgc

SEQ ID NO: 1515 - DNA, 20 bp, Artificial
  Synthetic oligonucleotide
gcgaaacgcgatttgttgtt

SEQ ID NO: 1516 - DNA, 19 bp, Artificial
  Synthetic oligonucleotide
catctggaggagggaggga

SEQ ID NO: 1517 - DNA, 153 bp, Artificial
  Synthetic oligonucleotide
gcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatg

SEQ ID NO: 1518 - DNA, 1172 bp, Artificial
  Synthetic oligonucleotide
ccctggctttcgactagcgtccgctgagctccaggctggtggcgcgtcacttagctggggaagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1519 - DNA, 1489 bp, Artificial
  Synthetic oligonucleotide
ctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgttaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1520 - DNA, 1183 bp, Artificial
  Synthetic oligonucleotide
ctcccaggcgcgtgctggctgtggtttgctttctcaatgctggtgtcctggggagctgacgtcccccagctcagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaa

SEQ ID NO: 1521 - protein, 52 aa, Homo sapiens
MYLTRERRLEISKTINLTDRQVKIWFQNRRMKLKKMNRENRIRELTSNFNFT

SEQ ID NO: 1522 - protein, 116 aa, Homo sapiens
SQARAGCGLLSQCWCPGELTSPSSEEIKAENTTGNWLTAKSGRKKRCPYTKHQTLELEKEFLFNMYLTRERRLEISKTINLTDRQVKIWFQNRRMKLKKMNRENRIRELTSNFNFT

SEQ ID NO: 1523 - protein, 24 aa, Homo sapiens
SQARAGCGLLSQCWCPGELTSPSS

SEQ ID NO: 1524 - DNA, 63 bp, Artificial
  Synthetic oligonucleotide
ccctggctttcgactagcgtccgctgagctccaggctggtggcgcgtcacttagctggggaag

SEQ ID NO: 1525 - DNA, 74 bp, Artificial
  Synthetic oligonucleotide
ctcccaggcgcgtgctggctgtggtttgctttctcaatgctggtgtcctggggagctgacgtcccccagctcag

SEQ ID NO: 1526 - DNA, 306 bp, Artificial
  Synthetic oligonucleotide
gtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgtt

SEQ ID NO: 1527 - DNA, 19 bp, Artificial
  Synthetic oligonucleotide
ctcgctcccttgctcacac

SEQ ID NO: 1528 - DNA, 20 bp, Artificial
  Synthetic oligonucleotide
aaagggaaagcgggatgttt

SEQ ID NO: 1529 - DNA, 120 bp, Artificial
  Synthetic oligonucleotide
ctcgctcccttgctcacacacacgcacacactcagcctggccgagcaggagccactgaccattttgcaagtgtcaggaccagctacagcgcggtgggcgcaaacatcccgctttcccttt

SEQ ID NO: 1530 - DNA, 19 bp, Artificial
  Synthetic oligonucleotide
acatccccctggaacggat

SEQ ID NO: 1531 - DNA, 24 bp, Artificial
  Synthetic oligonucleotide
cagaaattagcaaagcattgatgg

SEQ ID NO: 1532 - DNA, 91 bp, Artificial
  Synthetic oligonucleotide
acatccccctggaacggatatctgtttggggcactacaatctatcctgtagaactatggccaaatctccatcaatgctttgctaatttctg

SEQ ID NO: 1533 - DNA, 4096 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1534 - DNA, 3081 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1535 - DNA, 3021 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1536 - DNA, 2889 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1537 - DNA, 4406 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaaa

SEQ ID NO: 1538 - DNA, 4214 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaagaaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaaa

SEQ ID NO: 1539 - DNA, 2775 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1540 - DNA, 2829 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1541 - DNA, 2715 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtta

SEQ ID NO: 1542 - protein, 536 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1543 - protein, 387 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1544 - protein, 6 aa, Artificial
  Synthetic peptide
MDQTML

SEQ ID NO: 1545 - protein, 353 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1546 - protein, 323 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1547 - protein, 638 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1548 - protein, 574 aa, Homo sapiens
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1549 - protein, 285 aa, Homo sapiens
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1550 - protein, 289 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1551 - protein, 251 aa, Homo sapiens
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 1552 - DNA, 314 bp, Artificial
  Synthetic oligonucleotide
aggggagtgggaggggtgggggtgaggggagaggcgagaggtttagcgtgtggagctgcctgcgctccgcccgggctgtcagtcccggctccagccgccgcgagaccttcccggagacgcgcgcacacacagcgcaccccctgcacaccgcacaccctcgctcccttgctcacacacacgcacacactcagcctggccgagcaggagccactgaccattttgcaagtgtcaggaccagctacagcgcggtgggcgcaaacatcccgctttccctttccgggatttagtctgggagacgacgacgagggaagaag

SEQ ID NO: 1553 - DNA, 308 bp, Artificial
  Synthetic oligonucleotide
aaaccagaggagtcctgtctgggggtcccatcattattcgggatacccgccgccagcggcctgccttcggttacccacatccccctggaacggatatctgtttggggcactacaatctatcctgtagaactatggccaaatctccatcaatgctttgctaatttctgggacttaactcgtagaatctacatacagggctggaatttattcaaaatgcatctgaagaaatgacattttaaaccgttttaaaaaatatcttgataaaaaattctgtaaaacagaatttgataggtttaaaaacatgacag

SEQ ID NO: 1554 - DNA, 140 bp, Artificial
  Synthetic oligonucleotide
gagaatttaggggaagtcagactaatccctgggtgcacttcgagagaaaggttggacctcgcctgagggatgctggatctgcaatgatagaattggcctgccacagacattggtatttaagttgaagagcagaattcaca

SEQ ID NO: 1555 - DNA, 200 bp, Artificial
  Synthetic oligonucleotide
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttgg

SEQ ID NO: 1556 - DNA, 24 bp, Artificial
  Synthetic oligonucleotide
ggttcggatggactacactttgtc

SEQ ID NO: 1557 - DNA, 22 bp, Artificial
  Synthetic oligonucleotide
ccacgtacttctgggtgatgtc

SEQ ID NO: 1558 - DNA, 94 bp, Artificial
  Synthetic oligonucleotide
ggttcggatggactacactttgtccgtacccaccacgtagcagagaaaaccaccttgtatgacatggacattgacatcacccagaagtacgtgg

SEQ ID NO: 1559 - DNA, 4783 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaagtcttgagatggaattccctgggagagcacctgatgagccagcccattcagctgccacacaaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1560 - DNA, 4656 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1561 - DNA, 4798 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaagtcttgagatggaattccctgggagagcacctgatgagccagcccattcagctgccacacaaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1562 - DNA, 4671 bp, Artificial
  Synthetic oligonucleotide
cggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggctcggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgaggaatggttcctg

SEQ ID NO: 1563 - protein, 1044 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1564 - protein, 1521 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1565 - protein, 1049 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1566 - protein, 1526 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTPMKPESLENSILDSLEPQSLASLLSESESPQEAGRGHPSFLPQQKESSEASELILYSLEAEVTVTGTDSQYCRKEVEAGPGDQQGDSYLRVSSDSPKDQSPPEDSGESEADLECSFAAIHSPAPPPDPAPRFATSLPHFPGCAGPTEDELSLPEGPSVPSSSLPQTPEQEKFLRHHFETLTESPCRELFPAALGDVEASEAEDHFFNPRLSISTQFLSSLQKASRFTHTFPPRATQCLVKSPEVKLMDRGGSQPRAGTGYASPDRTHVLAAGKAEETLEAWRPPPPCLTSLASCVPASSVLPTDRNLPTPTSAPTPGLAQGVHAPSTCSYMEATASSRARISRSISLGDSEGPIVATLAQPLRRPSSVGELASLGQELQAITTATTPSLDSEGQEPALRSWGNHEARANLRLTLSSACDGLLQPPVDTQPGVTVPAVSFPAPSPVEESALRLHGSAFRPSLPAPESPGLPAHPSNPQLPEARPGIPGGTASLLEPTSGALGLFQGSPARWSEPWVPVEALPPSPLELSRVGNILHRLQTTFQEALDLYRVLVSSGQVDTGQQQARTELVSTFLWIHSQLEAECLVGTSVAPAQALPSPGPPSPPTLYPLASPDLQALLEHYSELLVQAVRRKARGH

SEQ ID NO: 1567 - DNA, 122 bp, Artificial
  Synthetic oligonucleotide
ggttcggatggactacactttgtccgtacccaccacgtagcagagaaaaccaccttgtatgacatggacattgacatcacccagaagtacgtggccgtggcctgccaggaccgcaatgtgag

SEQ ID NO: 1568 - DNA, 15 bp, Artificial
  Synthetic oligonucleotide
agctcttccccgcag

SEQ ID NO: 1569 - protein, 5 aa, Artificial
  Synthetic peptide
ELFPA

SEQ ID NO: 1570 - protein, 891 aa, Homo sapiens
GVTMAAVGSGGYARNDAGEKLPSVMAGVPARRGQSSPPPAPPICLRRRTRLSTASEETVQNRVSLEKVLGITAQNSSGLTCDPGTGHVAYLAGCVVVILDPKENKQQHIFNTARKSLSALAFSPDGKYIVTGENGHRPAVRIWDVEEKNQVAEMLGHKYGVACVAFSPNMKHIVSMGYQHDMVLNVWDWKKDIVVASNKVSCRVIALSFSEDSSYFVTVGNRHVRFWFLEVSTETKVTSTVPLVGRSGILGELHNNIFCGVACGRGRMAGSTFCVSYSGLLCQFNEKRVLEKWINLKVSLSSCLCVSQELIFCGCTDGIVRIFQAHSLHYLANLPKPHYLGVDVAQGLEPSFLFHRKAEAVYPDTVALTFDPIHQWLSCVYKDHSIYIWDVKDINRVGKVWSELFHSSYVWNVEVYPEFEDQRACLPSGSFLTCSSDNTIRFWNLDSSPDSHWQKNIFSNTLLKVVYVENDIQHLQDMSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTP

SEQ ID NO: 1571 - protein, 414 aa, Homo sapiens
MSHFPDRGSENGTPMDVKAGVRVMQVSPDGQHLASGDRSGNLRIHELHFMDELVKVEAHDAEVLCLEYSKPETGLTLLASASRDRLIHVLNVEKNYNLEQTLDDHSSSITAIKFAGNRDIQMISCGADKSIYFRSAQQGSDGLHFVRTHHVAEKTTLYDMDIDITQKYVAVACQDRNVRVYNTVNGKQKKCYKGSQGDEGSLLKVHVDPSGTFLATSCSDKSISVIDFYSGECIAKMFGHSEIITSMKFTYDCHHLITVSGDSCVFIWHLGPEITNCMKQHLLEIDHRQQQQHTNDKKRSGHPRQDTYVSTPSEIHSLSPGEQTEDDLEEECEPEEMLKTPSKDSLDPDPRCLLTNGKLPLWAKRLLGDDDVADGSAFHAKRSYQPHGRWAERAGQEPLKTILDAQDLDCYFTP

SEQ ID NO: 1572 - DNA, 28 bp, Artificial
  Synthetic oligonucleotide
actcactcagagactaacacaaaggaag

SEQ ID NO: 1573 - DNA, 26 bp, Artificial
  Synthetic oligonucleotide
agtatgggaagaatttactggtcaca

SEQ ID NO: 1574 - DNA, 106 bp, Artificial
  Synthetic oligonucleotide
actcactcagagactaacacaaaggaagtaatttcttacctggtcattatttagtctacaataagttcatccttcttcagtgtgaccagtaaattcttcccatact

SEQ ID NO: 1575 - DNA, 3483 bp, Artificial
  Synthetic oligonucleotide
ggccattccaatggaacagacagggtaaggaccaatctggactgtgttatcttttccaggtgcaagtatgtgctatggaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 1576 - DNA, 3344 bp, Artificial
  Synthetic oligonucleotide
ggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatga

SEQ ID NO: 1577 - DNA, 1247 bp, Artificial
  Synthetic oligonucleotide
agcaacacattcaggcaaagggatgcgagaagaactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 1578 - DNA, 5710 bp, Artificial
  Synthetic oligonucleotide
aggttacttgactgggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 1579 - DNA, 5663 bp, Artificial
  Synthetic oligonucleotide
cgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgctgacggccacccaccatcatctaaagaagataaacttggcaaatgacatgcaggttcttcaaggcagaataattgcagaaaatcttcaaaggaccctatctgcagatgttctgaatacctctgagaatagagattgattattcaaccaggatacctaattcaagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctggggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacataactcctagttataactatgcaccaaatatggataaacactggattatgcagtacacaggaccaatgctgcccatccacatggaatttacaaacattctacagcgcaaaaggctccagactttgatgtcagtggatgattctgtggagaggctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatagtcccacagatcgttctcaacattgacttggcccccacgatcctggatattgctgggctcgacacacctcctgatgtggacggcaagtctgtcctcaaacttctggacccagaaaagccaggtaacaggtttcgaacaaacaagaaggccaaaatttggcgtgatacattcctagtggaaagaggcaaatttctacgtaagaaggaagaatccagcaagaatatccaacagtcaaatcacttgcccaaatatgaacgggtcaaagaactatgccagcaggccaggtaccagacagcctgtgaacaaccggggcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaaagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtgttttattcttcccaatgactctatccattgtgagagagaactgtaccaatcggccagagcgtggaaggaccataaggcatacattgacaaagagattgaagctctgcaagataaaattaagaatttaagagaagtgagaggacatctgaagagaaggaagcctgaggaatgtagctgcagtaaacaaagctattacaataaagagaaaggtgtaaaaaagcaagagaaattaaagagccatcttcacccattcaaggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaacctgggatctttctgtgcttgcacgagttctaacaataacacctactggtgtttgcgtacagttaatgagacgcataattttcttttctgtgagtttgctactggctttttggagtattttgatatgaatacagatccttatcagctcacaaatacagtgcacacggtagaacgaggcattttgaatcagctacacgtacaactaatggagctcagaagctgtcaaggatataagcagtgcaacccaagacctaagaatcttgatgttggaaataaagatggaggaagctatgacctacacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 1580 - protein, 630 aa, Homo sapiens
MCYGTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1581 - protein, 4 aa, Homo sapiens
MCYG

SEQ ID NO: 1582 - protein, 546 aa, Homo sapiens
MSHCCRKSSPKCHLPLALDLSHHRVPLYRVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 1583 - protein, 29 aa, Homo sapiens
MSHCCRKSSPKCHLPLALDLSHHRVPLYR

SEQ ID NO: 1584 - protein, 139 aa, Homo sapiens
SNTFRQRDARRTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSMFRTNKKAKIWRDTFLVERG

SEQ ID NO: 1585 - protein, 11 aa, Homo sapiens
SNTFRQRDARR

SEQ ID NO: 1586 - protein, 871 aa, Homo sapiens; identical to SEQ ID NO: 1419

SEQ ID NO: 1587 - DNA, 162 bp, Artificial; identical to SEQ ID NO: 281
  Synthetic oligonucleotide

SEQ ID NO: 1588 - DNA, 78 bp, Artificial
  Synthetic oligonucleotide
ggccattccaatggaacagacagggtaaggaccaatctggactgtgttatcttttccaggtgcaagtatgtgctatgg

SEQ ID NO: 1589 - DNA, 32 bp, Artificial
  Synthetic oligonucleotide
agcaacacattcaggcaaagggatgcgagaag

SEQ ID NO: 1590 - DNA, 266 bp, Artificial
  Synthetic oligonucleotide
ggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacag

SEQ ID NO: 1591 - DNA, 831 bp, Artificial
  Synthetic oligonucleotide
gtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacattccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagaga

SEQ ID NO: 1592 - DNA, 14 bp, Artificial
  Synthetic oligonucleotide
ggcggcggcaggat

SEQ ID NO: 1593 - DNA, 15 bp, Artificial
  Synthetic oligonucleotide
gtcgggagcgcaggg

SEQ ID NO: 1594 - DNA, 129 bp, Artificial
  Synthetic oligonucleotide
ggcggcggcaggatcggccagaggaggagggaagcgctttttttgatcctgattccagtttgcctctctctttttttcccccaaattattcttcgcctgattttcctcgcggagccctgcgctcccgac

SEQ ID NO: 1595 - DNA, 2533 bp, Artificial
  Synthetic oligonucleotide
cccgtcacatgcgatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaatcttga

SEQ ID NO: 1596 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 1597 - DNA, 161 bp, Artificial
  Synthetic oligonucleotide
tcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccc

SEQ ID NO: 1598 - DNA, 21 bp, Artificial
  Synthetic oligonucleotide
ccccagactctgtgcacttca

SEQ ID NO: 1599 - DNA, 24 bp, Artificial
  Synthetic oligonucleotide
tgggctctgctctgtcttagtgta

SEQ ID NO: 1600 - DNA, 110 bp, Artificial
  Synthetic oligonucleotide
ccccagactctgtgcacttcagaccagcagcagcaggagggctcccgagggccttatgagaaaacctgtgtggacatcccttggtgtacactaagacagagcagagccca

SEQ ID NO: 1601 - DNA, 5390 bp, Artificial
  Synthetic oligonucleotide
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1602 - DNA, 5453 bp, Artificial
  Synthetic oligonucleotide
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1603 - DNA, 4543 bp, Artificial
  Synthetic oligonucleotide
ttccattttcctaataccagacacaaacaagagagatggcaaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgacaactgagatgggggaagccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcgtgtccaccttggaatctggctgaactggctgggaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaactttttcga

SEQ ID NO: 1604 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1605 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1606 - protein, 516 aa, Homo sapiens
MARICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 1607 - DNA, 43 bp, Artificial
  Synthetic oligonucleotide
ttccattttcctaataccagacacaaacaagagagatggcaag

SEQ ID NO: 1608 - DNA, 1199 bp, Artificial
  Synthetic oligonucleotide
ctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctac

SEQ ID NO: 1609 - DNA, 2871 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1610 - DNA, 2514 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctggtgagactccaacccacagcccagctgtggctgcacagtgagcctgatgggaggtggggaacagggacagggggccacctgggcttcttcacagagaggtcagcaggaaggcttggctacagtgcaaggttggctgagctgtgacaaggtcttctctgtctccagtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1611 - DNA, 2706 bp, Artificial
  Synthetic oligonucleotide
ctccagcagcacccgagagggtcaggagaaaagcggaggaagctgggtaggccctgaggggcctcggtaagccatcatgaccacccggcaagccacgaaggatcccctcctccggggtgtatctcctacccctagcaagattccggtacgctctcagaaacgcacgcctttccccactgttacatcgtgcgccgtggaccaggagaaccaagatccaaggagatgggtgcagaaaccaccgctcaatattcaacgccccctcgttgattcagcaggccccaggccgaaagccaggcaccaggcagagacatcacaaagattgaggctccagggaccatagagtttgtggctgaccctgcagccctggccaccatcctgtcaggtgagggtgtgaagagctgtcacctggggcgccagcctagtctggctaaaagagtactggttcgaggaagtcagggaggcaccacccagagggtccagggtgttcgggcctctgcatatttggcccccagaacccccacccaccgactggaccctgccagggcttcctgcttctctaggctggagggaccaggacctcgaggccggacattgtgcccccagaggctacaggctctgatttcaccttcaggaccttcctttcacccttccactcgccccagtttccaggagctaagaagggagacagctggcagcagccggacttcagtgagccaggcctcaggattgctcctggagaccccagtccagcctgctttctctcttcctaaaggagaacgcgaggttgtcactcactcagatgaaggaggtgtggcctctcttggtctggcccagcgagtaccattaagagaaaaccgagaaatgtcacataccagggacagccatgactcccacctgatgccctcccctgcccctgtggcccagcccttgcctggccatgtggtgccatgtccatcaccctttggacgggctcagcgtgtaccctccccaggccctccaactctgacctcatattcagtgttgcggcgtctcaccgttcaacctaaaacccggttcacacccatgccatcaacccccagagttcagcaggcccagtggctgcgtggtgtctcccctcagtcctgctctgaagatcctgccctgccctgggagcaggttgccgtccggttgtttgaccaggagagttgtataaggtcactggagggttctgggaaaccaccggtggccactccttctggaccccactctaacagaacccccagcctccaggaggtgaagattcaacgcatcggtatcctgcaacagctgttgagacaggaagtagaggggctggtagggggccagtgtgtccctcttaatggaggctcttctctggatatggttgaacttcagcccctgctgactgagatttctagaactctgaatgccacagagcataactctgggacttcccaccttcctggactgttaaaacactcagggctgccaaagccctgtcttccagaggagtgcggggaaccacagccctgccctccggcagagcctgggcccccagaggccttctgtaggagtgagcctgagataccagagccctccctccaggaacagcttgaagtaccagagccctaccctccagcagaacccaggcccctagagtcctgctgtaggagtgagcctgagataccggagtcctctcgccaggaacagcttgaggtacctgagccctgccctccagcagaacccaggcccctagagtcctactgtaggattgagcctgagataccggagtcctctcgccaggaacagcttgaggtacctgagccctgccctccagcagaacccgggccccttcagcccagcacccaggggcagtctggacccccagggccctgccctagggtagagctgggggcatcagagccctgcaccctggaacatagaagtctagagtccagtctaccaccctgctgcagtcagtgggctccagcaaccaccagcctgatcttctcttcccaacacccgctttgtgccagcccccctatctgctcactccagtctttgagacccccagcaggccaggcaggtaaggagttggctgggaaggagtgtgaacacaagaggtcctcacctcactgtgagctgcacacctgccctgcccctaccccaggcaatctcatgcttccacaccttccaccctggcccagcctggctctccctcaggaagaggggaggggctgcacttccagccctgtgctcctaattggcttggccgttggtgggggaggaggagaggacagtacatggtggaagtataggaccccagacctccctctaaattttccatgcccctcaggcctcagcaatctggcccctcgaaccctagccctgagggagcgcctcaaatcgtgtttaaccgccatccactgcttccacgaggctcgtctggacgatgagtgtgccttttacaccagccgagcccctccctcaggccccacccgggtctgcaccaaccctgtggctacattactcgaatggcaggatgccctgtgtttcattccagttggttctgctgccccccagggctctccatgatgagacaaccactcctgccctgccgtacttcttccttttagcccttatttattgtcggtctgcccatgggactgggagccgcccacttttgtcctcaataaagtttctaaagta

SEQ ID NO: 1612 - protein, 87 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLRLQGP

SEQ ID NO: 1613 - protein, 5 aa, Homo sapiens
RLQGP

SEQ ID NO: 1614 - DNA, 23 bp, Artificial
  Synthetic oligonucleotide
ttttcaaatgggtagggaccatc

SEQ ID NO: 1615 - DNA, 21 bp, Artificial
  Synthetic oligonucleotide
tgagtttctctgggacccgga

SEQ ID NO: 1616 - DNA, 103 bp, Artificial
  Synthetic oligonucleotide
ttttcaaatgggtagggaccatccatggagcagctggaacagcagtggggagcatcagaaccagctcaacagtttgtctactgtccggtcccagagaaactca

SEQ ID NO: 1617 - DNA, 22 bp, Artificial
  Synthetic oligonucleotide
tgtttctccaaatgccagaacc

SEQ ID NO: 1618 - DNA, 19 bp, Artificial
  Synthetic oligonucleotide
ggctggtgacctgctttga

SEQ ID NO: 1619 - DNA, 126 bp, Artificial
  Synthetic oligonucleotide
tgtttctccaaatgccagaacccaacattgatagtcccttgaacacacatgctgccgagctctggaaaaaccccacagcttttaagaagtacctgcaagaaacctactcaaagcaggtcaccagcc

SEQ ID NO: 1620 - DNA, 19 bp, Artificial
  Synthetic oligonucleotide
gaggcgaggagtgtggcac

SEQ ID NO: 1621 - DNA, 17 bp, Artificial
  Synthetic oligonucleotide
gctgcgatgggcacgtt

SEQ ID NO: 1622 - DNA, 130 bp, Artificial
  Synthetic oligonucleotide
gaggcgaggagtgtggcactttggcggggaaggggcggctcagccctcgggccctcgcccgccctctccgggtctggagcgtctcctcgcgccatccctgcaccgccagggggaacgtgcccatcgcagc

SEQ ID NO: 1623 - DNA, 20 bp, Artificial
  Synthetic oligonucleotide
cctagcagctcgtctccagc

SEQ ID NO: 1624 - DNA, 18 bp, Artificial
  Synthetic oligonucleotide
ggtgtcctcgccgaacct

SEQ ID NO: 1625 - DNA, 120 bp, Artificial
  Synthetic oligonucleotide
cctagcagctcgtctccagctaaaaatcctccagagccaccggcgaacactgctaggcacagcctggtgccaagctacgaagcgcccgccgccgccgtgcgcaggttcggcgaggacacc

SEQ ID NO: 1626 - DNA, 1582 bp, Homo sapiens
tttttgtttgtgtacttaataaagggtaaatatgtcatgtttgtttggaacagtcatggttaatatctatgttgtcccagtatatctattaatagaactctctttcactctcaacagcgtcctagtccggatgacaaattatatggttatctctcagtaaagggtctttttttaaaatgatttttttttcagggggtagggtaggcaggaagcttaaactgggtaatttagttgtagaagagtgccctgtggcaaataattgattattcatttccagcatccccttttcttctccttgacagttattaaaaaaaaaaaagttaccagcttatgtcattttaaagaacactcgccctgaaaacttctgagaggttggccatttgaaaccctggttttagtgtctgtattattagtgaactaccgtgttcccatgtggctacacaaccacaattatgtactatctggctctttaccaaagtttgcagacctctaatctagagtgcgacatttcccctcattaactcttaggtcccttggctctaaaagggtatattcatcttggccctatacagggaaagggggaatgggattaatgatgtgctttgtaagaagaaccaattttaattttcacaaaggcttgacgtagctgtgagagaaagggtaagaagaagcaggcttcttcttagaagtctgagatggcctaaagtggtgggggaagaagggagagtggggagaaagagaaacaagaaaagctgagagtgaattccccagagaggtagccactgattctgccctactctttgctggaattctggaaaacacctgggcttctaaaagatagggagctcatgcatcatggtagggccacagctcaggctagggccagagatagctcagagtagcgccacggctcagggtaggtccacagtgcagggtagggccatagctcagagtagggccatagctcataaccacagctcagggtaggacctgctgatctatttggggacccccagcagagcctgtctaattgcatatcttgaaaaggattggaaaactgtcataatgacattattccctctcactttccttgtccaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcttacagtg

SEQ ID NO: 1627 - protein, 64 aa, Homo sapiens
MRIAVICFCLLGITCAIPVKQADSGSSEEKQLYNKYPDAVATWLNPDPSQKQNLLAPQVFLNFS

SEQ ID NO: 1628 - protein, 32 aa, Homo sapiens
MRIAVICFCLLGITCAIPVKQADSGSSEEKQH

SEQ ID NO: 1629 - protein, 39 aa, Homo sapiens
MRIAVICFCLLGITCAIPVKQADSGSSEEKQVSIFYVFI

SEQ ID NO: 1630 - DNA, 101 bp, Artificial
  Synthetic oligonucleotide
tggcaagaagaaggtctggttagaccccaatgagaccaatgaaatcgccaatgccaactcccgtcagcagatccggaagctcatcaaagatgggctgatca

SEQ ID NO: 1631 - DNA, 20 bp, Artificial
  Synthetic oligonucleotide
cggtttgctgcggtaatcat

SEQ ID NO: 1632 - DNA, 21 bp, Artificial
  Synthetic oligonucleotide
tttcttgctgccagtctggac

SEQ ID NO: 1633 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 1634 - DNA, 26 bp, Homo sapiens
gaaggctcttgtcacttactagccat

SEQ ID NO: 1635 - DNA, 24 bp, Homo sapiens
tgtcaccatatttaatcctcccaa

SEQ ID NO: 1636 - DNA, 101 bp, Homo sapiens
gaaggctcttgtcacttactagccatgtgattttggaaagaaacttaacattaattccttcagctacaatggaattcttgggaggattaaatatggtgaca

SEQ ID NO: 1637 - DNA, 21 bp, Homo sapiens
ggcgtctttctccctctgaac

SEQ ID NO: 1638 - DNA, 20 bp, Homo sapiens
gtcccattctgggtgctgtg

SEQ ID NO: 1639 - DNA, 114 bp, Homo sapiens
ggcgtctttctccctctgaacctcagtttccacctgtgtcgagtgtgggtgagacccctcgcggggagctatgcaggttacggagaaaaggcagcacagcacccagaatgggac

SEQ ID NO: 1640 - DNA, 20 bp, Artificial
  Synthetic oligonucleotide
ggacggatacagcaggaacg

SEQ ID NO: 1641 - DNA, 23 bp, Artificial
  Synthetic oligonucleotide
tattttccaaaaaaggccagctc

SEQ ID NO: 1642 - DNA, 95 bp, Artificial
  Synthetic oligonucleotide
ggacggatacagcaggaacgaaaaaacatccgacccaacattattcttgtgcttaccgatgatcaagatgtggagctggccttttttggaaaata

SEQ ID NO: 1643 - DNA, 23 bp, Artificial
  Synthetic oligonucleotide
gttgcatttctcagtgctggttt

SEQ ID NO: 1644 - DNA, 16 bp, Artificial
  Synthetic oligonucleotide
agggtgccgggtgagg

SEQ ID NO: 1645 - DNA, 106 bp, Artificial
  Synthetic oligonucleotide
gttgcatttctcagtgctggtttctaatcagaccagtggattgagtttctctaccatcctccccacgttcttctctaagctgcctccaagcctcacccggcaccct

SEQ ID NO: 1646 - DNA, 18 bp, Homo sapiens
accagccacctcaaccca

SEQ ID NO: 1647 - DNA, 22 bp, Homo sapiens
ctggagcagagagtctttgcct

SEQ ID NO: 1648 - DNA, 110 bp, Homo sapiens
accagccacctcaacccaaggccctgggcaatcagcagccttcgtgggattcagaggatagcagcaacttcaaagatgtaggttcaaaaggcaaagactctctgctccag

SEQ ID NO: 1649 - DNA, 25 bp, Artificial
  Synthetic oligonucleotide
gaaggcacaggaaaaacagatattg

SEQ ID NO: 1650 - DNA, 21 bp, Artificial
  Synthetic oligonucleotide
tggtgctcttggtcacaggat

SEQ ID NO: 1651 - DNA, 119 bp, Artificial
  Synthetic oligonucleotide
gaaggcacaggaaaaacagatattgcatcacgttaccctaccctttggactgaacaggttaaaagtcggcagaacaaaaccaataagaattcagtgtcatcctgtgaccaagagcacca

SEQ ID NO: 1652 - DNA, 21 bp, Artificial
  Synthetic oligonucleotide
ccctgtgccttatttgaccct

SEQ ID NO: 1653 - DNA, 19 bp, Artificial
  Synthetic oligonucleotide
gctgggtagactgggtgca

SEQ ID NO: 1654 - DNA, 101 bp, Artificial
  Synthetic oligonucleotide
cctgtgccttatttgaccctcatgccaaccccgggaggtggagactgttgccccactctgcagatgcagaaacggaggcttggctgctgccagggggagga

SEQ ID NO: 1655 - DNA, 20 bp, Artificial
  Synthetic oligonucleotide
gctgattgtccccatgaagg

SEQ ID NO: 1656 - DNA, 20 bp, Artificial
  Synthetic oligonucleotide
tggcatacgggaactcagtg

SEQ ID NO: 1657 - DNA, 101 bp, Artificial
  Synthetic oligonucleotide
gctgattgtccccatgaaggccagccttgaagcttggtcagtctccctaactgtatgattgatccccacttattgcactacatcactgagttcccgtatgc

SEQ ID NO: 1658 - DNA, 24 bp, Artificial
  Synthetic oligonucleotide
attgaataattcagcacctgaggc

SEQ ID NO: 1659 - DNA, 22 bp, Artificial
  Synthetic oligonucleotide
ttcatatggctactccccacct

SEQ ID NO: 1660 - DNA, 104 bp, Artificial
  Synthetic oligonucleotide
attgaataattcagcacctgaggctggtggatgattctttgcaatttggcaggaatgggagagtcgggagcagtagttggcaaggtggggagtagccatatgaa

SEQ ID NO: 1661 - DNA, 27 bp, Artificial
  Synthetic oligonucleotide
ttctcatagtattccattgattgggta

SEQ ID NO: 1662 - DNA, 21 bp, Artificial
  Synthetic oligonucleotide
caccggtatggagaatagcga

SEQ ID NO: 1663 - DNA, 107 bp, Artificial
  Synthetic oligonucleotide
ttctcatagtattccattgattgggtataccaggttctgtttacttttacttggcagttgatagaataggtgtagtttatactttttcgctattctccataccggtg

SEQ ID NO: 1664 - DNA, 21 bp, Artificial
  Synthetic oligonucleotide
accccaaacccaacttgattc

SEQ ID NO: 1665 - DNA, 21 bp, Artificial
  Synthetic oligonucleotide
tcagtggtggagccaagtctc

SEQ ID NO: 1666 - DNA, 101 bp, Artificial
  Synthetic oligonucleotide
accccaaacccaacttgattcctgccatatggaggaggctctggagtcctgctctgtgtggtccaggtcctttccaccctgagacttggctccaccactga

SEQ ID NO: 1667 - DNA, 22 bp, Artificial
  Synthetic oligonucleotide
ctcctgaaccctactccaagca

SEQ ID NO: 1668 - DNA, 21 bp, Artificial
  Synthetic oligonucleotide
caggcgatcctatggaaatcc

SEQ ID NO: 1669 - DNA, 101 bp, Artificial
  Synthetic oligonucleotide
ctcctgaaccctactccaagcacagcctctgtctgactcccttgtccttcaagagaactgttctccaggtctcagggccaggatttccataggatcgcctg

SEQ ID NO: 1670 - DNA, 20 bp, Artificial
  Synthetic oligonucleotide
caagcaattgagggaccagg

SEQ ID NO: 1671 - DNA, 29 bp, Artificial
  Synthetic oligonucleotide
caaaaaacattgttaatgagagagatgac

SEQ ID NO: 1672 - DNA, 113 bp, Artificial
  Synthetic oligonucleotide
caagcaattgagggaccaggaagtggatcctctagagatgaggaggcattctgctggatgacttttaaaaatgttttctccagagtcatctctctcattaacaatgttttttg

SEQ ID NO: 1673 - DNA, 22 bp, Artificial
  Synthetic oligonucleotide
atttccatcctcaactggcaga

SEQ ID NO: 1674 - DNA, 16 bp, Artificial
  Synthetic oligonucleotide
tgccctggaacccacg

SEQ ID NO: 1675 - DNA, 104 bp, Artificial
  Synthetic oligonucleotide
atttccatcctcaactggcagagatgagagcctggagcattgcagatgccagggacttcacaaatgaaggcacagcatgggaaacctgcgtgggttccagggca

SEQ ID NO: 1676 - DNA, 20 bp, Artificial
  Synthetic oligonucleotide
tctgctggccactgtgactg

SEQ ID NO: 1677 - DNA, 21 bp, Artificial
  Synthetic oligonucleotide
gaagaaaaagagctcgcctcg

SEQ ID NO: 1678 - DNA, 136 bp, Artificial
  Synthetic oligonucleotide
tctgctggccactgtgactgcagcatatgccctcagcatgtgtccctctctcccaccccagccagacgccccgccagatgcctgtgaggcctcctttgacgcggtctccaccatccgaggcgagctctttttcttc

SEQ ID NO: 1679 - DNA, 25 bp, Artificial
  Synthetic oligonucleotide
acatttggttcttccaagggactac

SEQ ID NO: 1680 - DNA, 19 bp, Artificial
  Synthetic oligonucleotide
tcgatctcagagggcaccc

SEQ ID NO: 1681 - DNA, 111 bp, Artificial
  Synthetic oligonucleotide
acatttggttcttccaagggactactggcgtttccaccccagcacccggcgtgtagacagtcccgtgccccgcagggccactgactggagaggggtgccctctgagatcga

SEQ ID NO: 1682 - DNA, 26 bp, Homo sapiens
acactaaaagaacaaacaccttgctc

SEQ ID NO: 1683 - DNA, 22 bp, Homo sapiens
tcctcagaaggcacatgaaaga

SEQ ID NO: 1684 - DNA, 106 bp, Artificial
  Synthetic oligonucleotide
acactaaaagaacaaacaccttgctcttcgagatgagacattttgccaagcagttgaccacttagttctcaagaagcaactatctctttcatgtgccttctgagga

SEQ ID NO: 1685 - DNA, 20 bp, Homo sapiens
agtgatggagcaaagtgccg

SEQ ID NO: 1686 - DNA, 21 bp, Homo sapiens
cagcagctgatgcaaactgag

SEQ ID NO: 1687 - DNA, 132 bp, Artificial
  Synthetic oligonucleotide
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 1688 - DNA, 21 bp, Artificial
  Synthetic oligonucleotide
gtccttccagtgcaagaccca

SEQ ID NO: 1689 - DNA, 16 bp, Artificial
  Synthetic oligonucleotide
tgggcctggcaaagcc

SEQ ID NO: 1690 - DNA, 149 bp, Artificial
  Synthetic oligonucleotide
gtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggccca

SEQ ID NO: 1691 - DNA, 19 bp, Artificial
  Synthetic oligonucleotide
ccgacggctcctacctcaa

SEQ ID NO: 1692 - DNA, 21 bp, Artificial
  Synthetic oligonucleotide
ggaagctgtagcccatggtgt

SEQ ID NO: 1693 - DNA, 102 bp, Artificial
  Synthetic oligonucleotide
ccgacggctcctacctcaataagctgctcatcacccgtgcccgccaggacgatgcgggcatgtacatctgccttggcgccaacaccatgggctacagcttcc

SEQ ID NO: 1694 - protein, 1189 aa, Homo sapiens
EGLGEQASWAMVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 1695 - protein, 717 aa, Homo sapiens [sequence omitted]

SEQ ID NO: 1696 - protein, 478 aa, Homo sapiens; identical to SEQ ID NO: 1418

SEQ ID NO: 1697 - protein, 871 aa, Homo sapiens [sequence omitted]

SEQ ID NO: 1698 - protein, 40 aa, Homo sapiens
LRSCQGYKQCNPRPKNLDVGNKDGGSYDLHRGQLWDGWEG

(The sequence listing continues in the following parts.)

---

What is claimed is:

1. An isolated antibody that specifically binds to an epitope in a polypeptide consisting of the amino acid sequence of SEQ ID NO: 253.

2. An epitope binding fragment of the antibody of claim 1.

3. A kit for detecting lung cancer, comprising the antibody of claim 1.

4. The kit of claim 3, wherein said kit further comprises at least one immunoassay reagent.

5. The kit of claim 4, wherein said immunoassay is selected from the group consisting of an enzyme linked immunosorbent assay (ELISA), an immunoprecipitation assay, an immunofluorescence analysis, an enzyme immunoassay (EIA), a radioimmunoassay (RIA), or a Western blot analysis.

6. The antibody of claim 1, wherein said antibody is attached to a label.

7. The antibody of claim 1, wherein said antibody is provided on a solid support.

8. The antibody of claim 1, wherein said antibody is a monoclonal antibody.

9. The antibody of claim 1, wherein said antibody is a polyclonal antibody.

* * * * *